US012767975B2

(12) United States Patent
Chenchik et al.

(10) Patent No.: US 12,767,975 B2
(45) Date of Patent: *Oct. 20, 2026

(54) MULTIPLEX PREPARATION OF BARCODED GENE SPECIFIC DNA FRAGMENTS

(71) Applicant: Cellecta, Inc., Mountain View, CA (US)

(72) Inventors: Alex Chenchik, Redwood City, CA (US); Costa Frangou, Sunnyvale, CA (US); Mikhail Makhanov, San Francisco, CA (US); Russell Paul Darst, IV, San Bruno, CA (US); Donato Tedesco, Berkeley, CA (US); Lester Kobzik, Mountain View, CA (US)

(73) Assignee: Cellecta, Inc., Mountain View, CA (US)

( * ) Notice: Subject to any disclaimer, the term of this patent is extended or adjusted under 35 U.S.C. 154(b) by 237 days.

This patent is subject to a terminal disclaimer.

(21) Appl. No.: 17/892,550

(22) Filed: Aug. 22, 2022

(65) Prior Publication Data

US 2023/0227889 A1 Jul. 20, 2023

Related U.S. Application Data

(60) Continuation of application No. 17/587,500, filed on Jan. 28, 2022, now abandoned, which is a division of application No. 16/543,211, filed on Aug. 16, 2019, now Pat. No. 11,274,334.

(60) Provisional application No. 62/799,448, filed on Jan. 31, 2019, provisional application No. 62/765,124, filed on Aug. 17, 2018.

(51) Int. Cl.

*C12Q 1/68* (2018.01)
*C12Q 1/6806* (2018.01)
*C12Q 1/686* (2018.01)

(52) U.S. Cl.

CPC .......... *C12Q 1/6806* (2013.01); *C12Q 1/686* (2013.01)

(58) Field of Classification Search

None

See application file for complete search history.

(56) References Cited

U.S. PATENT DOCUMENTS

| | | | | |
|---|---|---|---|---|
| 5,994,076 | A | 11/1999 | Chenchik et al. | |
| 6,265,165 | B1 * | 7/2001 | Xu | C12N 15/1096 435/6.16 |
| 2003/0082758 | A1 | 5/2003 | Rosen et al. | |
| 2003/0186246 | A1 | 10/2003 | Willey et al. | |
| 2006/0121452 | A1 | 6/2006 | Dhallan | |
| 2008/0050393 | A1 | 2/2008 | Tang et al. | |
| 2013/0123120 | A1 | 5/2013 | Zimmermann et al. | |
| 2013/0244897 | A1 | 9/2013 | Lueking et al. | |
| 2013/0274117 | A1 | 10/2013 | Church et al. | |
| 2015/0038343 | A1 | 2/2015 | Eamon et al. | |
| 2015/0087535 | A1 * | 3/2015 | Patel | C12Q 1/6806 506/4 |
| 2016/0251714 | A1 | 9/2016 | Conant et al. | |
| 2016/0257993 | A1 * | 9/2016 | Fu | C12Q 1/6869 |
| 2016/0362748 | A1 | 12/2016 | Mongan et al. | |
| 2016/0376664 | A1 * | 12/2016 | Chenchik | C12Q 1/6806 506/4 |

FOREIGN PATENT DOCUMENTS

| | | | |
|---|---|---|---|
| CN | 107385042 | A | 11/2017 |
| WO | WO2004051218 | A2 | 6/2004 |
| WO | WO2008069906 | A2 | 6/2008 |
| WO | WO2011014811 | A1 | 2/2011 |
| WO | WO2013081864 | A1 | 6/2013 |
| WO | WO2013128281 | A1 | 9/2013 |
| WO | WO2013138510 | A1 | 9/2013 |
| WO | WO2016172126 | A2 | 10/2016 |
| WO | WO2017210469 | A2 | 12/2017 |
| WO | WO2018119447 | A2 | 6/2018 |

OTHER PUBLICATIONS

Giardina et al., Whole genome amplification and real-time PCR in forensic casework, BMC Genomics, Biomed Central, 2009, vol. 10, No. 1, p. 159.

Lin et al., Multiplex genotype determination at a large number of gene loci, Proc Natl Acad Sci USA, 1996, vol. 93, No. 6, p. 2582-2587.

Langmann et al., Real-time reverse transcription-PCR expression profiling of the complete human ATP-binding cassette transporter superfamily in various tissues, Clin Chem, 2003, vol. 49, No. 2, p. 230-238.

Myllykangas et al., Chapter 2 Overview of Sequencing Technology Platforms, Bioinformatics for High Throughput Sequencing, 2012, p. 11-25.

Clarke et al., Modular tagging of amplicons using a single PCR for high-throughput sequencing, Molecular Ecology Resources, 2014, vol. 14, p. 117-121.

Parkinson et al., Preparation of high-quality next-generation sequencing libraries from pictogram quantities of target DNA, Genome Research, 2012, vol. 22, p. 125-133.

(Continued)

*Primary Examiner* — Suryaprabha Chunduru

(74) *Attorney, Agent, or Firm* — Jonathan Mares; Bret E. Field; Bozicevic, Field & Francis LLP

(57) ABSTRACT

Methods of preparing a plurality of sample-barcoded anchor-domain-flanked gene specific deoxyribonucleic acid (DNA) fragments from a template nucleic acid, e.g., ribonucleic acid (RNA), sample are provided. Aspects of the methods include employing a set of gene specific primer pairs, wherein each pair of gene specific primers is made up of a forward primer and a reverse primer, at least one of which includes a sample barcode domain. The methods find use in a variety of different applications, including high-throughput sequencing, e.g., expression profiling, applications, including of small biological samples, e.g., single-cells.

24 Claims, 87 Drawing Sheets

Specification includes a Sequence Listing.

(56) References Cited

OTHER PUBLICATIONS

Head et al., Library construction for next-generation sequencing: Overviews and challenges, BioTechniques, 2014, vol. 56, No. 2, p. 61-77.
Blomquist et al., Targeted RNA-Sequencing with Competitive Multiplex-PCR Amplicon Libraries, PLOS One, 2013, vol. 8, No. 11, e79120, 14 pages.
Markoulatos et al., Multiplex polymerase chain reaction: a practical approach, Journal of Clinical Laboratory Analysis, 2002, vol. 16, p. 47-51.
Shen et al., MPprimer: a program for reliable multiplex PCR primer design, BMC Bioinformatics, 2010, vol. 11, p. 143.
Zhao et al., Comparison of RNA-Seq and Microarray in Transcriptome Profiling of Activated T Cells, PLOS One, 2014, vol. 9, No. 1, e78644, 13 pages.
CoPrimers by Co-Disgnotics Inc., downloaded in Apr. 2015, 1 page.
Karn, High-Throughput Gene Expression and Mutation Profiling: Current Methods and Future Perspectives, Breast Care, 2013, vol. 8, p. 401-406.
SureSelectXT RNA Target Enrichment for Illumina Multiplexed Sequencing: Strand-Specific RNA Library Prep and Target Enrichment Protocols, Agilent Technologies, Version FO, Apr. 2018, 67 pages.
SMARTer® Target RNA Capture for Illumina® User Manual, Clontech Laboratories, Inc., 23 pages.
Gaublomme et al., Nuclei multiplexing with barcoded antibodies for single-nucleus genomics, Nature Communications, 2019, vol. 10, p. 1-26.
Mamanova et al., Target-enrichment strategies for next-generation sequencing, Nature Methods, 2010, vol. 7, No. 2, og. 111-118.
SeqCap RNA Enrichment System User's Guide, Version 1.1, Roche Sequencing Solutions, Inc., 2017, 51 pages.
Samorodnitsky et al., Evaluation of Hybridization Capture Versus Amplicon-Based Methods for Whole-Exome Sequencing, Human Mutation, 2015, vol. 36, No. 9, p. 903-914.
Stoeckius et al., Cell "hashing" with barcoded antibodies enables multiplexing and doublet detection for single cell genomics, Genome Biology, 2018, vol. 19, p. 1-16.
Xu et al., Detection of splice isoforms and rare intermediates using multiplexed primer extension sequencing, Nat Methods, 2019, vol. 16, No. 1, p. 55-58.
Zheng et al., Anchored Multiplex PCR for Targeted Next-Generation Sequencing, Nature Medicine, 2014, vol. 20, No. 12, p. 1479-1486.

* cited by examiner

FIG. 7

TABLE 1

| | | | |
|---|---|---|---|
| | GGCAGCAACTCGGG | CTGGAAGAACCCGC | AGCTGTGCGCAAGA |
| GCCCAGGAAGCCGA | CCGCCTACAGAGGG | CACGCGACGATACC | GGCGGAACCTCATG |
| CCACGGCCAACGCC | GGAGATAGGCGCCC | GGCGATCAGGGCAG | GAGTAGGGTGAGGC |
| GCCAAGGGACCAGC | CAAGTGGCCGGCGG | TACACGAGAACCGA | ACCGTGACGGCAGT |
| GACCGCAGCCGAGG | GCGACGAGGCCACT | GACACCTCCCCAAA | CCCACAGCAAAATT |
| ACCACAGAACCCAA | AGCGAGACGGTGCC | AGCGCGTCGAACAG | ACCGAAATCCTCAC |
| CGACAGGGGGAGAG | TCGGCAGAACGCCG | AATCCCCCGCCCAA | AGACCAAGGGAGTT |
| GGAAGAGCACCGGG | CCGAACCGGGTGAA | CAGCAACGAAACGT | TAAAGGCCGAATGG |
| GCCCGAAGCACGGA | GACCAATACACGCC | ACCCGCAAAGGTGG | CACCCCGTTGGAAA |
| GACAGCCGACCAAC | AGGAGCCGGTAAAA | GCATAAACGGACCA | GTAGCCCCACAAAT |
| GAGGCAAGGGGCCC | CAGTAGCCCGAGAA | ATCCAGAGCCAACC | TGAGGGCGTAACAC |
| ACGAGCAGCAGAGG | CGCACACATCACGC | CAACCGGTCACGGG | AGGGACGCTGCGTG |
| CCCCAGCGCAGACA | GCTCAGCGCCAAAG | GGAGGCCAGCCTAG | ACCAACTGACGCTC |
| AGACAAAGCCGAAG | GAGAAACAAGATGC | CAGAACTAGCACGA | GCAATCACGCGTAA |
| CACCGAGGGGAACG | CCAAATAACAAAAG | AGACCCGCAATCAG | TCTCCGGACGCACC |
| CAAGCGCGACACGA | AACAGCGACACGGT | ACCCCCTCGACCGC | CGGGTCGCCTGAAA |
| CACCCGAAAGCCAG | ACCAAGACGACCAT | AACCGTCCGCAGCG | GAAAAAGTAGGATG |
| GCGAGCGAGACGAG | GCAAGACCCTCACC | AGAGCACGTAAGGG | GAGGCGGTCATAAA |
| AGAGGAGCAAGGGA | ACCATCACCAAGCC | AGACGGGCACATGC | GTGGTAGCGCGCGA |
| GACGGTCCCGACAC | CGAGACCCTCCAGA | GATAAAGGAGCCCC | AATTCCACACAAGA |
| ATACGAACGACGGC | GCTCCAGGCAGCCA | CACAGCTGGAACCA | CAACGGCGTGGAGT |
| AGCTCGGCCAAGAA | AGCTGAGGACCAAG | GAAAGACAACGAGT | ACGGGTCATGGGAC |
| ACGAGAGTAGCCGA | CCACCCTGGACACG | CGAGGAAAAGGTTA | GGACCTGGACACGT |
| ATGAGCGGAAAGAA | CCAGGAAACACCTA | AACCCAAGTGTAAA | GAAAAATACGGTCG |
| GGCAAAAACCCATC | CAGGAATCCGGCCA | GCAAACTCCGGGAT | CGCAGGACATTCCC |
| AGGGGAGACCCGTC | GTGGCCGAGGCAGG | GCCACTTGGGCCAG | GTTACCGCAGGGCG |
| AGCAAGGGCCTGCG | CAAGGCAGCGGTGC | AGGCCCACAGCGTT | GACAAGCCCGTTGA |
| GCCGCAAAGTGGGA | AAGCCGCACACTCC | TGCTACGGCACACA | TGCGTGGCGACGAC |
| GCCCAAAGTCGAAC | AGCCAGGCAACTAC | CTCTCAAAGAAAGA | ATCAGAACATAAGA |
| CAAGGTCGCCGGGA | CTCCAAGCCCCGGA | GCACCCCTCACAGT | ACAAGCCGCATGTC |
| AATGACGGCAAGCC | CGTGAACCCCACCC | ATCCAGGCAGAGTG | TAGAGGCGGGCCTC |
| GAGCCACGAGTCAC | GTACAAGCCGGCCA | CAGGATAAAGACTG | CATAGAAGCCGTAA |
| GAGGCGCAATACAC | ACAGACGAACACTC | CTCCAACTCGGGGG | CCGTAGGACAAGTG |
| TAGGGAACCACACC | CAAACAAAGCGATG | TATGGGAGCCAACG | TGAGACGCGAGCAT |
| GGGGAATGACCAGA | AAGCGGTGACAGGC | TCCACGCGCTGCAC | CCACACAAATCTAG |
| ATGAAGAAACAAGG | TAGCACGCCGACAG | TCTAAGCGCGCGAG | ACGCCGTCCAGCTG |
| AACACGAGCGGTAG | GTACCCCAGCGGAC | GGGGGAACTAGGTG | AGAGGGACCTTCAC |
| GGGGACGACTACGA | CACAGGCGGTGGGC | AGGCGCAGAATAAT | CTAGGCATAGCCAG |
| GGAGACAAGGGGCT | CACAGGAGACACTC | ATCACCAAGTCCGG | GAGCACGTCCATCC |
| CCTGCAAAGGAACG | AAGCACCATGCGGA | CACAGTACGAAGAT | ACAAATTCAGCGAC |
| GCGAATGGAAAGCA | GCACTACCAGGCAA | GCGCAACCGTTAAC | AGAACATGGGTCCG |
| CGGGCTCGGACACA | GGCGAGGGAGGTCA | CCCCATACCCACGT | CGCGATGCCGCACT |
| GGAGCGACGTAAAC | GGTACAAACAACCG | GGTTAGAAGCCCCG | GCGGAGTGTAACAA |

FIG. 7 (Cont.)

| | | | |
|---|---|---|---|
| CTTACACCGGAAGC | GGCACTGCTGACAA | CGCCCATGCCGTAG | GAAGCTGTAGGGCG |
| AATGGAGAAGCCTA | CTAACCACACTCAA | CTGCACCACTGGGA | CCGGACTCGACCTA |
| GAGCGACACGCTAT | CGCTGCATGGGACC | CAGCGGGTCGATCA | CCTCCGACGGTGAG |
| ATGGTCAAAAACGA | GAGCATACGCATAG | AGGGCACACCTTCG | AAGGACAACAATAT |
| CCGGACGTGTAAAC | AAGACCTAAAGACT | GAGTGGGCAGCGGT | GAGCAGAGTCGCGT |
| ATGCGACAAATAGC | GGCCAAATCCACTG | AACAACTCCGTGGC | TGACCGCAGCACCT |
| CGTTCGAGGAGCAC | AATTGGAACGCGCC | TGTAAAGCCCCCGC | GGCGACCGACCTAT |
| CGTCGGAACAACAT | CGCGAGCTACCGGT | GCACACGTAAAGTG | TCAGGCCAGACAGT |
| TGCATCGGCCACCG | ATCGCAGGGCGTGC | AACGGCCTCCTCGC | AGAATCCGCAGTGA |
| TTCGCACACCAAGC | AGGGACCTTCAACA | CTCCGCTACGCGAA | GACAGAATGGCAAT |
| GATGACCCGAAGAT | AGAGACCTCGGCTG | ACTGAACCACTGGA | ACTGAACTGAGGAC |
| GCTTGGGAGAGGGC | CCCGACCCGTTCAG | AGACGGTCCGGTAG | AGAAAGGGACGTAT |
| AACACCTGGATGGG | ACTTCACCGCAAAG | AGGGTAGTGAGCGG | CATCCGCAGCGTAA |
| CCACTCGCTCCGCA | ATGAAAAACTGGCC | GGAGCGCTGCATCC | CCTAGTGACGGCCG |
| ATCAAGCGGTGAAG | CGCGTACGCTAACG | TTACCCAGGCAAAA | ATAGCCATAGAGCA |
| AGCAGGCGAAGTTA | GCTCCCGCTCAGGA | GTCAGAGATACCGC | AGCCGTGAACGTCG |
| CGAGGGTCGAGTCG | AGTCGACCTGAGCA | AGCGGAGGTACGGT | AACAGAAATCAGTC |
| ACCCAAAAACTTCG | AAACGAAGCGGCTT | CTCCGAGCTAGGAC | TACAAAGGCTAGCA |
| AGGCTGGAGGATAG | CGCAACTAGGATAC | CCAAAGATAGATCA | CGATGCGACCAACT |
| TGATCCAGAGGCCA | CGTATGGAAAACAG | GGGCGAAAGGTACT | AGGCCGACTCATAC |
| AAGACCACTTCCCA | CGCAGTCGGTCCAG | GTTGCAGGGAACCC | CTGCGGCACCGTGG |
| AGATGTAGCGGAGG | AAGCGTCGTACGGG | GTCTGGCAGCAGAA | AAATAAATCGGGAT |
| GAAACGCACCTGCT | GCCGGTGCGTAAAC | TCGGAGAACGTGAG | ATATGGTGAGCAAC |
| AGGGCAGTAGGACT | GGACTACACACGTG | CGGTGGAGCGCTCA | ATGCCAGAACATAT |
| GATCCTAACCAACC | CGTGAACGAAGTCA | GAGCGCCTTAGCAC | TCAAAGTAACATAA |
| CAGCGTCGCGAGTG | CATACCGGACACCT | TGGCCAGAGTCGCC | GGGCAAGCTCTGTG |
| GTACTAACACAGCA | CAGTAAGCCCAATG | GCAAGTCGGCGCTC | GAAGGGGCTTCCTC |
| AGAGGTGAACAAAT | CTCGAAGCCTACGG | CCCAATCGTAGGAA | CTAGAGGGAGCTTG |
| CCCCTAAGGGCCTG | GGAATGGCGTACCA | CGTGGGGAACGGCT | AGAGAATTTAGGCG |
| TGCCGTCGCGAAAC | GGTCGAGGGACGTA | ACCACCGACTGGAT | CCGTAACCGCCCTT |
| CCACATCGCAACCT | ACGTGAGATAGCAC | CAACCAGCGATTAG | TATGTGCAGGGGAG |
| GCGGCTGCCTCACG | TGAGACATCCCGAG | GGCACCCTCTGAAC | AACGGTGGGTTCCA |
| CACTACAAGGGGAT | GTCCGCGATAAGCG | TAAAAAGACGCGTA | ATAAATCCAATCAC |
| TAGACCCCCTGACC | GAACTGGCTCAAGG | ACCAGCCAGCTCAT | TAGCTGACTCGGGG |
| ACCGGGAACTTACC | CATAGGTAGGGCAC | GACAACGGGTGTGC | GATTGACGGGCTCC |
| TAGATAACCGGGCA | CAATGATGCGAAAC | CTAGCCCAATCCGA | ACTTATAAGGCAAC |
| CTGGGGGAAGCAAT | GTGCCCGTCCCAAG | CTATCCAAACGAGC | CTTGCTACACCCAC |
| CGGCTATGGCCCAG | ACGACACGCGTTGA | GAAGCGTACGCTCC | TACCTCAAAAATGA |
| TCTGCGAGGGGCGA | CTTCAGACAAACAC | ACGTTCGCAGGAAA | TGAAGTTCAGGCGA |
| CCCAGGGGCTTCGA | GAGAAGAAGCTTAC | GAATGACGATAAGG | TGAGCCCACTTACC |
| TGGGGACCTGCGAC | GGAGGTCTAAGCGG | GAAATAACGATCAG | ATTAAGCAATACCC |
| GCATTAGCAGAGCG | AAGCCCGACATGTA | CAATGCAACATGGC | GAAATCTTCCGCGA |
| TGAGACCACAGTCG | GAAGCGAGGTTCCA | CTACAACGGCTGCG | GAGGTAGAACAATT |

FIG. 7 (Cont.)

| | | | |
|---|---|---|---|
| CTCGGCGATCTCAA | ACCGATCGTATCGC | TCACAATATGACAC | GGGTACAGTCGGTG |
| CGGTATTGAGAGCG | CTATACGGCCTACC | CTATTGCGGGAGAA | CTGTAGGGCGTCAA |
| CCTTGGTCCCGAAG | GCTAACACGGCTTC | GAGATCCGCTGTAC | GTAAATCCCCTACC |
| TGATCGACCTCGGC | ACGTAGGAGCGTAT | AAATCGATGGCGCT | GACCATTGACGGTG |
| TGCGGGTGGTGACC | GGATGGGCTAGATC | TCACGAGATCCGTA | AATGGCGAGGTGTG |
| TCCACCTAGGGCTG | CCTAATGTGGCCCA | CTATGCCGGGCCAT | TACTGAATAACAGG |
| GCACCTGCTGGATA | GGTGAGTTACACAC | TAGTCCCTACGGAC | ATCATAGCTCCCAC |
| GCCCTGCCGCTTGA | AAGCTACCTCACCT | AGGATGAGTTGGCG | GCGTCCTTCCCCAC |
| GGGCATCTAGAATA | GCACATTCGATGAC | GCGGCTGTGAACCT | GCTACAACTGACTG |
| AGGTTGTGGGCGGG | CAATCGCTAATCGC | TTGAGCGAAGGTCA | GTGGAGGCTTCAGC |
| TACTCCCGTCAACA | GCGCTGGCTTCGGA | GTATCCCGGATAGA | CGATCTATCACCCC |
| TAAAGCTGAGTCAA | TGCGTCGGGTAACA | AACGCCATATCGCT | CCCGTCTAGGCGTA |
| GTACGCAAATTAGC | CTGGGAACAGTTCC | TCTATAACGGCAGA | GGCTGACCTAAGTC |
| GTAAGTGGGCTAGG | AGAGCTGCACTGGT | GCTCACTGACTACG | CGACTGGAAGTTCA |
| TATGGCGCAACGTA | GAACTAACTTGCCC | CGTCGCACAATTCG | AGCTCAAGTTCGAG |
| ACCAGACGTCTGTA | TGAGTACCCAGCCT | AGTAGAGTAATGCC | CGTTGCGGCTGACA |
| GGTAATACGCTACG | CTCGCTGACGGCTG | GTGCTCATAACAAA | GCCTACCGGTCCGT |
| ACTCCCCTCGTAAC | CCAATATCCGCATG | GGGTTGCAAGAACT | GGCATACCCTTGGG |
| CACGTGGCTCCGCT | TAGAATGACAATGA | CCTGACATTCCCCA | GAAAACACTTGTCA |
| ACGGCGTACTATAC | TCAGCGTAGTAGGA | GGCAATTCCGATCA | GCTACGTACAGCTA |
| GCCAACGTATATCA | TACCGCGACTCCAT | GCACAGTATCTCGA | TACATGACATACAA |
| CTTAAACCCGTCAG | CTAGGTACTCGCCA | AGGGGCTATGTCGC | AAATGTTACCCCGA |
| CCTGTTGCGGAAGG | CCGTCGGTGTCGCG | GCGCTGGAAGTAGT | CCCCTGATGATGAA |
| ACATTGCGGTCCGC | GAAGACCTACGGTT | TCGTGTCGACGCCA | GACTCTCCATGCCC |
| GAGACACTGCTTCG | GAATGTCACTGAAA | CTACCATTGCCGGA | ACACCTTCCCGGGT |
| ACTATACCCGGTCA | ACAAACTAAATCCT | CACTGCAATCAAAT | GACGGCTGATATGA |
| GTCCACCTGTGACA | TGTGGTGGCGGCCA | AAGTCACCTTAGAG | GGGAGAGGATGATT |
| GCATCAGGCGGTTC | TATATCCGCAACCC | AAGGCATTATAACG | AGATAATGGAAAGT |
| ATCAAGGAGGCTTC | TCGCTATAAGGACA | ACCTAGACCGCTTC | ACCGTAAACGGTTG |
| GTGCCTTAAAGGCA | ATCCAGACGCGTTA | AGCGGACTAGTCGT | TTATAACAAAGGCA |
| TGGCCTCCACAGTG | CATATCCCACCATA | TGGACTCACGTCCC | GATGCTGACAGTCA |
| TGAGGAGGACTTCG | TCCGAGGCCCTTGA | ATAGTCCGCCTAGA | GCAACAATTCCTCA |
| GTCCCGAGCTCGTC | CAAGCTGGGGGTGT | CATTCACCCCGTCA | GACGTCATACCTAC |
| CAGCTATTCCGAGG | GTGAAATCAGTGAG | TTAGCACCGGTGCC | GACTGGTGAAAATG |
| TAAGATCCCAAGCT | GGGATTACATAACG | CCATGACCCTTCAA | CTCCATCGAATCAA |
| ACCCCATAGCTGCT | GATCCCTGCCGGTA | ATCAGTTCAACGCC | GGTCGGGGATCTCA |
| AGCTGCCTGTACCA | ACACTCCCATTGAA | CCACATATCGCGTA | ATACGCGAAGTGCT |
| TCAGACATTAAAAA | CTGGACCGGAGTTA | AAAGACTCAATTAG | ACCGGCTCGGTCCT |
| AGTAGAGGTGGTAG | CGACAGCTTATGGC | GTCCGGATTAAAAA | TAAATACGGTACAC |
| ATGTGCTACGCCCG | AGGTGGGTGCCTCC | TTACGCTCGGAAGG | TGGGACTGAGCTCC |
| CGCAGAAATATTCG | ACGACCGCCTTTAG | ATCGCCGTCACTAC | GTTCCAACGCCAAT |
| CGGTGCCTATAGGG | TGGGAGTACTGCCA | CGTGCCCTTAGCAA | CTAAGGTAATACCG |
| CCCCGTCTGACTCA | GCGTAGGATCCATG | CCAAATTCGGATGA | CCTCCTCGGAGGGT |

FIG. 7 (Cont.)

| | | | |
|---|---|---|---|
| GTAGCAGATGACGT | AATAGTGCGCTGAA | CCTACACCTAGAGT | ACGGTATCTATACG |
| AGGAAAGGCATCTT | GACAGGTATCAACT | CACGATTTGGAGAA | ATACTACTAAACTA |
| GAACAGCATTGTAA | GAATCACTTCAAGC | CCTCAGAGTAGTGG | CTACGGTGTACTAC |
| CCCGATCTAAATGC | CACTATAAAACTGG | TATCGCAACAGATC | TGCTATAAAGGACT |
| CGGTGCCCAAGATT | ATGGAAACTACGCT | CAGCGCTGGGTTAA | AAGACTTTCATCGG |
| GAATCCGCAGTTCA | GCGTCGCATTGCGC | CGATCCGATGTCCA | CTTCCGGACCCTAT |
| GTAACAGCCTTGCA | CCTGGGTATAGCGA | CCATTCGATACAAA | TAAAATGCACTTCC |
| TATTAAAGCGAAGG | CGGACTGGGTAATG | ATCACAAATATGGA | AAGTCTTAGTCCGG |
| GAACTGAGTGAGTA | CCACCTGTACGGTC | CGAATAGCTTCCCG | AATTCTAGTACGCC |
| TCCAAGACTGACGT | GTGGCCATGGATAG | CGGAATTTGGGACA | GGCCGACGCGTTTT |
| CATAAGATTCGCAC | CCAAGTTACGAGAT | GAGGCTCGGTCTGG | TGGCATAGCGTGTC |
| AGGGCTGATGTGAA | CAAGGGTGAGGGTT | GGTATCGAGGCTAA | TATTGCCCCAGTAG |
| AGACCATACTAATG | CGCTAAGGACGTGT | CATGTAAAACGTAG | TACAAGTCTCTGAG |
| GAACCGGACATCTT | AGTTATAAGAAGCA | ATGTACAGCAAATG | AAAACTGTACCTGT |
| AATACTGAGGTCCG | TGTGACAGACGCTA | CCACCGTGATATCT | TCCTACGGTGTCGG |
| ACGTTGGTCGAAGA | GGAGGGCATTGCTG | TCGAGAAGACTTTC | TGTAAGCTCAGCGT |
| GCTAGTGGACCGTA | CCCTGTGATAAAGG | CCCTGGTTACCAGT | CGTACGGTACCGTT |
| AGACGCCTATCGTG | CGCCTTAAAGCTAA | GCTTATCCCGAGAT | TGGAGGGTATAATG |
| GTCAGACAAGCTCT | CATAAGAGTATGCA | GGGAGTGGCTTCTG | ACGCAATTCTAAAT |
| GTTGCAAGTCCGCA | TGAAGCGAGAGATT | AAGGACGGTCTATT | ATTATGGGAGATCA |
| GCGAACCATATTGC | ACGAGCGTTCACAT | TTATCACGAGCGCT | TCAATGCTATAGGC |
| TTCATAGAGGCACG | GATGCCAAGTATCG | AGTAACGTTGATCA | CGTAGTTGAGTGGA |
| TTCACCGGGAGTAA | GGGCTGCCCCATGT | CCTTAGTATGCAAA | ACTTATACCAGCTA |
| GACTTGAATCGGAA | GCAACCTAACTAGT | CCAGTATGTGGGAT | GAATAGTAACGCTT |
| CTTGGGAGTGAGAC | CTGCCTCTCGGCCG | TTAGTAACAGACTC | ATTGGAACTGTCAC |
| GCCAGATAATGCAT | CGCGCAGTGTTCGG | GCAGGTTCACCGTT | AGTACTACAGATTG |
| ACTAAACCGTTCCC | CGACGGGGTTACTC | GTGCTCTACTGCAC | ACCCGCTATCCTCT |
| TCGCGCTGGCACTG | GTGAAACTTCGGCA | ACATATGCGCTCGT | TAAACTAATTGCGG |
| TACACGTACGTCCG | CTACTACCCTACCG | ATTGTAATGCCCCA | AATACTCCAATGGT |
| AGAGCCGGTTTCAA | AACTAAGTATGGGA | ACACGCTGTAACTT | GTTCCAGCAGTTAC |
| CAAATACTGCTGGA | CCGGATGTGATGGG | GACACCATTGCTGT | TCGCATGTAAGATA |
| CTCGCGACAGTCGT | TAAAACAACCTGTG | GCAGTCTATGTAAC | TTTGCGAAGATACG |
| GAATCTACCGCTGC | CAAGAATATGTGCA | TTAGAGATGACGGT | GACCCGTGTTAAAT |
| CCAGGGGAAATTAT | CAACGTGGTCCCGT | TCTTAGACCAAACT | AGTGAGTGATTGGG |
| TCGTTAAGCGCACG | AGTGGAAAGCCTTG | ACGCGGTAATAATT | TGTGTCGCTCCACA |
| CAAGAGGCTCTAGT | CCCGATGTAGCGAT | TTCGCTACTAGGGC | ATGATCACATGGGT |
| CTAGTGAACTGAGG | CACCGCTCTATAAG | CGATTGCGGACTCT | GTACTGGGTGCAAT |
| CCCGAAGTTCACTC | CCCGAGTTGTCAAA | GATATAGCAACTGT | GACCACTTCTGCTC |
| TAACGAGTGGATAG | AACGCCCTTCCTCA | CCTAATGCCCGGTT | GTACGTCAATAGTG |
| CGACGTTTGCGAGA | ATATCCACGGATGA | AGAGGTCGGTTTAC | TGGCCCTCCGTTCC |
| AGTACTGAATCCCA | ACTAGATCATCGGA | TTACAAATCGCTGG | CTGGACAGTGTCTG |
| GAACGTCGGCTGAT | GTAGCGGCATGGTC | CTTATGATACCAAC | GGACAGTGTTCGTA |
| AGGGTGCGGCACTT | TTGGGCGAACACGT | GATGTCGTGGTCCA | TAGTGCCAGGGTTC |

FIG. 7 (Cont.)

| | | | |
|---|---|---|---|
| TTAGGGTCGCCGTC | GGTTGGTCCACGGT | ATCTTCCTGCCACA | TCGGGTGCTCCCTG |
| ATACAGTTCCAGTG | ATGGGCCTCAAATT | GACCTTGCTATCAG | TACATTGTGAACGG |
| ATGCCTGCTCAGTC | GATATCACCCTGAT | TCCACAATCTTAAA | TAGGTTCAACGTCA |
| CTTTAGCCATCACG | CGTGGTAACCTTCG | AGTGAGTTCCCATG | CCAATTGATGAATC |
| CTGAAAAATCTGAT | GCTTTATAGCGAGA | GTTCTTAGCGAGGC | GAAACTGGTTCTCG |
| ATGTAGGCCCTGGT | ATTCTACGTGAACG | TACCAGATGGGTGT | TGGTTGTCCGAAGC |
| TACCTTAAGTGGAA | ATGGACATGTGATG | GCATTCGGGTATAA | TGTGGCTCATCCGA |
| TTCGGACAGGTCCT | GTGGGGCTCTCCCT | CAGTACCCTTCATA | CAGAGCGTAGTTAT |
| GGTCTGTCGGCTCA | CCCGTCAGTGCTCT | GCAGCCATCCATTT | AATTTAGGCCCATC |
| CCCTCAGCAGTTCT | ATATCCAAAGCCTT | GGCCACTGTTTAAA | ATGAGGCGTACATT |
| CCGTGCACCGGTTT | TTGCTAGAAGCGTG | GCATCATGTAAAAT | TGTATAAACTGCAC |
| GTTATTCCGCGAAG | TAGCTTACAATCCG | TACGTGTGTACAGC | TACCTAGATCCTAC |
| ATTTAACGGAATAC | GGGTCATCCGTGCT | TATACTGCCGCATG | TCCAGCCATATGCT |
| CAGAGATTTCTGAG | AGTGTCACTATGGG | CATCATCGCTTACG | TATTAGCTCACGCG |
| CTCATGACTGAATC | TACGTAGTAGCCAT | CCCAATATACTTAC | TCGATTCGGTGCGG |
| GTGGCTGCCGGTTC | ATACCATGGTTAAC | TCTCAATTCGCGAA | CTAAATATGAGAGT |
| GTGCAGGAATTGTG | CTTCTCCGATCCAA | GATAATTCTGCGAA | GGGTGCTTTCGACA |
| CAAATGTACTCGTG | GGCCTTTTACCCCG | CGCTTGTAAGAGTC | AACAGATTTACATG |
| GTTAGGTAACGTCA | TGAAACTTCTCAAC | ATCGGGTTAAGATG | AAATAGCTACATCT |
| TCTAAGTGTAGCAC | TTAGAACTGGATAC | GGGCTCACGGATTT | AATCCCTGGGCTTA |
| TCAGTGACTACCAT | TGAACATTAGTAAC | TATGTCGCGAATAG | CCTAACAGCTCCTT |
| GTCTTCAACAGCTG | GAATGAATACCTGT | ACTGACTCCTGATG | TACAGATCTCGATA |
| ATAAAACTCTAGCT | AACTCAATGCCTTG | CTGTTTACAGGCGA | AGACATGTCTTAGA |
| CTGGGTGTTGGCGC | GTTGCGCAGTTGAG | GCCAATCTTCAGTC | TAATTCCCCTGGCG |
| GGCTCATAGTGAGT | GCGTCGATTGTACC | TCACGCGTAATTCC | GTGTAGATTCGACG |
| GTGCAGTTGTAGGG | TCGAAAAAGTGTAT | ACTGGTTACCCAAT | CGTAGATATTCCGA |
| TCGCAAGACTTATG | GTCACGCGGTCCTT | TGCGTAGTTAAGGA | CTTACAATCGCCTG |
| CGCATTTAGCAGTA | TTTAATCGAAAGAC | CGCCTCGATCTTGA | CGTACCTGGGTTGG |
| CTTCAGGGAATGGT | CTAGGCTGGATACT | TGGTCGTCCCGGTG | AATCCCTATAGTCC |
| AGCACATTTGGCTC | AGGAGTCAATGCTT | GTGGTTGTCCCGGC | CGTCCTTCAATCAA |
| ACCCGAGATTTTAC | TCTAGGGTTAGGCA | TACGGACCCGTATT | TCGGAGAGTCGTTG |
| GGTAGCAATGTATC | CTCCTCACAGGTGT | TGCCATCTGGATGG | GTGTGTTCAGAGGG |
| GGAATGTAGCTATC | TCTCATCCCACATC | CGGCTTCTCCCTGC | CGGTAACAATCTTC |
| GAGATTCTAACAAT | TAGTGAGGCGATTG | CGGTATGCTTAACA | GAGCTAGTAATGTA |
| CGCTCATCATATCG | CTAAGGGCTGCATT | GGGGAGGTTTTCAG | TGTGCTCGGTACAA |
| AAAAGTAGTTCGTC | AAAATCACTGTTAC | ACGGTGGTACTGCT | TGCTCTCACATAGG |
| ATGACAACTAATGT | GGTTTGGTAACGGA | AATCACATTGGGCT | CATAGCGTTTGCCA |
| AATTGAATCCTAAC | CAGTTATATAAGCG | TCGTACTCCGTCAC | ATACCACACTTCGT |
| TCTGGAAAGAGTCT | AGCATAATCATGCT | TTCCCGCTCGTAAA | GGACCGATTTATAG |
| ATGTACCGATAGTC | AGTCTCTAAGATCC | TCGCAAATTAATGC | ACATGTGTTCCCCG |
| ACTAGGCGTTCCGT | TGTAACTCCGGCTA | CACCGTTCCTTCGG | CTGGGTTCGTCCCA |
| GGTCGCACTTAATG | GACTCGTTAGCCAT | GGTCCTAGGTGACT | GCGGACCTCCTCTT |
| TCGTATAACGGCTC | GGTCGGTTGCCCTA | CAACATTCTTAAAG | TGCTCCTAACGATA |

FIG. 7 (Cont.)

| | | | |
|---|---|---|---|
| TCCGACAGGTGCTT | GTGGCAGTGATTAC | GCACTTAATTATCC | TCTAGACCAATTAT |
| ATGGAGTTCAGCTC | GTAGCCGTCATCGT | CATACGCATGTCTT | GGATCCCTTCTTAA |
| CGGCTTACTCAGAT | TAGATCGCTAACTG | CACTGTTTTGCAGA | TTGATCGGGCTGTC |
| CTGTCACTGCATAC | TCCCAACATATAGT | TTACCCGGATTCGT | GAGCCGTTGTTCCT |
| GGCGTTTCACTAAA | TCCTCGTACTGTGG | CTGGTGCTAATCAT | GGACTTCGCTGCTT |
| ACATTTTACGCAGC | GTTGGTCAGGGTTA | TGCCTATCTCAGTC | TATCGTGATTGGGG |
| CATTCATAACATGA | GGTTGGACCTTTAA | TGACTAATCGTGTA | TTCCGGGTCGCTGT |
| AATATATGCGAATG | CCTCCTCCTGCTTA | CCGATATCATGTTC | GCGATCGGTTTGCT |
| CGTTTAACCACATA | TTTCCGACTAGTAA | GTAGGAGTTCTCTG | CCCGCTTTCTCTGA |
| CGAACTAGTTGAAT | ACGAATTACGTATT | GATAGCCTTCATTA | GTACGCGTTTCGTC |
| GATTTAAGACGGTC | GAACATCGTATTTA | TGCTTAGCAAATAT | AATTCAGAATCTTC |
| ATTAGCGCACTCTG | GTCTCTTACAACTC | ACCTCTAATGTTCG | CCATCATGGCATTT |
| ACTTTGCCTAAAGA | TTCTAATCACGCTG | TCATACCGGACTTT | TGTAAACATCCTAT |
| TTGCTGCCTGCCCG | ATAATCAGTACTGT | GTGTATATCTAAAC | ACTTAAATGTACAT |
| CCACATTGTCATGG | GGGCTAAACTTTTC | TGAACCAGCTATTT | GTTAGTCCTACGGT |
| CCTATCCCGCTCCT | ATACACTGAGATTT | CGTTTTGGCCAGAT | CTGTAATGTATCGC |
| CGTATCGATTCGCA | TGTCTAAGTCGTGG | TTCTAATATGAGAA | CATCTCTTGGGCGT |
| CGTAAGTGTGAGTG | TTTAACTCACAGTC | GTCTACTCGGTTAG | ATGTGACCTATTGG |
| GTCCGATGACTCAT | ATGTCTTCAAGCAT | AATATTACAGTCCT | GAGAATCTCTTATA |
| TCGAACCCTTGTAC | TTCTTGCAAAGCTC | TAACAGAAGTTGTT | GGTCTTAGCACTTA |
| AACCTCTATACCGT | GTAGTATATAGGTC | TCATCGATACTTGG | AGTCTTGACGCTCT |
| CGTTGCAGCACGTT | AAATTTCTCTACGG | TTCCCGATTGCGAT | CCTATTTCTCCCAA |
| TCGTTCGTCGGGCG | GTCTCCGCTAGTCT | CTCTCGGGCTTTGC | TATGTATAAGCTAC |
| CGGTAAATTATGAG | TTTCATCCACGCGT | CTTCGGCTGGGATT | ACTACTGCTTCGTA |
| ACTGACGCGATTTA | GCTCGAATCTATCT | CCGAGGTTGTGATT | TCGTCAGTTTGGCA |
| CTGTAGATGCCCGT | CATGTTCCCGCTAT | CTTTGCAGTTGGGG | TAACTGTGGTGGCT |
| CCTAAGTTCGACGT | GTCTTGGACACTCT | TGTTATCCGGGATC | GTCGATTTATGCAG |
| ATGAGTCTCGCCTG | GTGAATCGGTTTCA | ATGTAGTAAGTTCA | CGTATATGTCATAC |
| AATGTAAATCTGCA | TACATGCTTTCGCC | AAGACGTTTGCTCT | TTATCGTCCGGATC |
| CCTCTACCCAATTC | GGTGGACTTATCCT | GTGGATCTTATAGA | TTATGGGTACGAGT |
| GTTGGTCGCAAGTG | CGCTTGGAGTTACT | ATCTGGGGACATTT | TGTTTCGTCCCCGG |
| CGCTGCCTACTTAG | TCTGGGTACCTTGG | CGTTCCTCTGCCTC | TCTCAGACTTCTGC |
| TTAACAGAGATTGG | CGGAGTATTGATTC | AATACCTCTCTCTA | CTACCATATGTCTG |
| TCAGTTAGGTAGCG | CAGTTGAATGTGAT | CGTCGCTTCGTTAG | GAGTTGGACGTTTC |
| CACAATGTTCTCGG | GATATAGGCTTGTC | TGACCTTATCCGTG | ATTAGCCTCTTCAG |
| ATCGCTAGATACTA | TACATCTCCATTAG | TGCCCATTGATGGT | CTATTATGATACGA |
| ATCTCGCTTAGACC | TGCGCAAATTTCCT | GGTGATGCCTTAAT | GTATCATACCTTGA |
| CGTCTCGTCGGGCT | ACGTAGTCATATAT | TGTGGAATCCGCTT | TTGTATAAACCCTG |
| CATTCAGCGCAGTT | GAAATACGTGTTCT | CCATTAATCCTAAT | TTCCGCGTAAACTT |
| TGGCGGTTGTGCAC | CTCAGGTAGGTTTG | TCAACGAAATTATT | TACTTGTAAACTAA |
| ATAGGTGTCATAAA | GATCGTTGCGATGT | CCGCTCTTTGGGTA | CCCCTTTTTCAGGA |
| ACCGTCTCAAGTTG | GGAGTTTGTATAGA | CTTGCCATGAGATT | TTTAGTGAGAGCCT |
| AAAGTCCTTTCGAG | GATTCAACTTCTAG | GTATTGCAGCTTCC | AACTTTTCATAGAC |

FIG. 7 (Cont.)

| | | | |
|---|---|---|---|
| CGCCTATATGGTTC | TCATGTATATCTGA | TTCTACTGTAGACT | TCGCTTAGTAAGTT |
| AGTCTTCGCCATTC | AAGCTGTCATTTTA | GTCGGCCTTTGTTC | TAAACATGCATTTT |
| TTAGACTAGAATCT | TTCCTTCTCCAGTA | CATGACTTCTGTCT | GTTTATCCCTTCGA |
| TGGAGCCTTAACTT | ATATCACGATTTTA | ATGCTGTCTCTGCT | CGATTGATTCTTCC |
| TCCGGCTGTCATAT | GATCTCATTTTAAG | TGGCGAGTTTTTGC | ACTGTCATCTTGTA |
| ACGTTATTGTCCGA | ATCTATGAATTGAT | ATTCGTTATCTGCC | GACTTCGTTTGCGT |
| TCTGTCCAACATAT | TCTTGTGTCGCATA | TTTTTGAACTGGGC | TTATATGAGGTTGT |
| TGACATCATTTAGC | CGTGTTTTCAGTAG | CTTCGGAGCTTTTG | TTTCAAGATTCTTC |
| TGATTTCCGCTAAA | CGTTTCACTCATCT | CGTGATATTATTGA | TGATTTATTCCATG |
| TTATTCGTAAGCGC | TTCATCCACTCCTT | CTATCGGTAGTTAT | TTAGAGCTTCTTCT |
| TTTCAAACTGACCT | TTCTTATGGTCAGC | CTATTAGTTTGAGG | CGAATGTGTTTTTA |
| TGTAACTAATTGCG | TCTATGCGATTTAA | TTAACTCTCCGTGT | GATGTCTACTTTTG |
| TCACTTTTGGCCGC | TTCTCATATCCCGT | TGCTTCTGAGTTAA | TCTGTTCGCTCATT |
| TGGTTCTGACCGGT | TACGTCTATTATAA | TCTCACGTTAGTTC | TTTGGTTCAGTGTG |
| ACGTGATCTTGGAT | TGACTCTCTCGTTG | CCTGTATTGTACTA | GCTACTCCTTTTAT |
| GCTTGTTCCTAACG | GTTTAACGTATATA | GTCATTATATCTAG | ATTGGTATTATGAT |
| CTTACTATAGGGCT | TTGATATCTCGTCA | TTTATTGATGAGGG | CGATTACTATTTGT |
| TTAAGGGATAGTTA | TAATAGTCTCCTCT | TTGTATTTCAACGA | TTAGCATATCATTT |
| GGCTTCTTCGCAAT | TGAAGTGTTCATGT | AAACTATTTCTGTA | TGTTCGAATCTTTG |
| ATCATGCTTGAGTA | TAATTTCGTCATAG | ATTTCTCAAGTCTC | CCCTTGTTCTTCTG |
| ATCGTCTCTATCAA | TATTAAGCTTTGGA | CCTGATGTATACTT | ATGTCTGTTGTTAC |
| TTTGACTTCCAAGA | CGTGTTGATCATTC | ATTAACTATGTGAT | TATGTTTTACACTA |
| TGTGGCCTGTTGCC | ACTTAGTTGTTAGC | ATGTGGTGTAATTC | TTTACCTGTTAATG |
| TTGCCTAGGATGGT | TTAGTCTGGGAGTT | TATTCACACTTATC | ACTTTATGTGTTAG |
| TGTCGTGACTTAAC | AATATTCTGTTGCG | TTCTATTGCGCTCG | ATGTGTTCCTGTTA |
| ATCTTAGTAACTGA | GTCGTCATGTTGCT | TTCATATACCATTA | CTCCCTTACCTTTT |
| CCCTTTCTACGTGA | TATCTAGTCCTTGG | CTGTCCTTCTGGTA | TGTCGTTGTTGTGC |
| CTATGATACAGCTT | AGATCATTGTTGTA | TTTAACAGTCTTGC | AATTTGCGTTTTAC |
| CTGTTTGGGCCGCT | ATTTTCCCTCGATC | CGTATTTAAGGTTG | TTTTTCCGACTGTG |
| CGGTCATGTCCTTC | AGATTTCCAGATTT | CTAGGGATTTGTAT | TTTTAGAGTTTCCC |
| CGATACTGTTACAT | TCATTATACTGATA | CGTCTATTTTGACA | GGCGTGTTATTGTT |
| GCTTCCTCACTTCC | TCCTCTTTGGGGAT | CGTACCTTCTTCGT | TGTGAACTTTTTAG |
| CTTGGATGCTTGAC | GACATTATCTAGTT | CTTACATGAAATTT | TCCAACATTTTTCT |
| TTCCTTCCGGCTCT | GTTCCATTGAATTG | TAATTAGGTTGTCA | TATTTTTGGCCACT |
| TCGCGTGATGTTGT | GTGATATTCACTTC | TTATATTTAGGCCC | GATAGTTATCTTAT |
| AAGCGTTACATTTT | GCTTATGCTTCCTG | CTTTGTGTCAACAT | GTTATCTTATGCCT |
| TTTTCCGACTGTAC | AGTTCGCTTTGGTG | TCTGGTTGTGCACT | GTTTTCTGCTTAGC |
| AGTTTCCTGCGTGT | GTTGTATAACCCTT | CTAACATGTCTATT | ATTTGGGAGTGTTT |
| TACAGTACTATTTG | GATTTCTTTCCAGC | CTAGTATTCTGTCC | TGTTATGTGCTGTC |
| GTCTGATTGGGTGT | CAGCTTCATCTTCT | TAAGACTATGCTTT | GGGTGTATATGTTT |
| CGAACTTTTCTGCT | TTCGTATTGAGCCT | TTCTGTATGAACCT | TGTGTCTTATGGTA |
| GAATATGTGTAGTT | TAGGTGTTTAGTGA | ATGTTGCATACTTA | TATTGTACTCTACT |
| GGTTGCCTTTCTCG | CCCATAGCTTTTTA | CAGTTTATTCATAC | CCTAATGATTTTTC |

FIG. 7 (Cont.)

| | | | |
|---|---|---|---|
| GACTGATTTTGATT | AAGGGGAGGCCCGG | CGACCCAAGAGAAA | ACCACACTCAACCA |
| TTTGGATTTGGTCT | GAGCAAGGGCACCG | AAACCCACGAAACG | CTAAACCCGGGGGG |
| CTTATTTTGCATTG | GGCCGACACAGCGC | GAACGCGAGCCGGA | CGGCATCCGACGAC |
| CTCTTGACATTTTT | CAACACGCGGAAGC | CACGCAAAAGAGGA | GCCGATAGCCCGAC |
| CATTTACCTATTTT | GAAACGGCCGCGGA | GCGGCACACGAGGA | AAGATCCGGACGGC |
| TTTGAATAGTTGTT | CACCAGAGGACGGA | AGGACGCAGCCACA | CAGCAGGTAGCGAA |
| TGGTTTATGAATTT | AACAACGGCGCCCG | GGAACGGGCAGAAG | GACACCCCAAATGC |
| TATTTGTTCTCTAC | ACACCCACACCCCG | CCACGGAGGAAGGC | GACTAGCCACCACA |
| TTTTGATACTTCTG | CACGAGGCCAAAAC | CCGACACAAGAGCG | GCGCAGCTACCAAC |
| GTACATTTTTCTGT | AAAAGGCACCCAAC | GGAGGGGGAGACCC | ACGATCCGGGACCG |
| TTGGTTTTTGACTG | CAACACCGAGCCGA | AAGCAGCCGGGGCC | CGCCAACCAGATCA |
| CTCTTTCGTTTCCT | GGCAAGACAAGAGA | CGCCAGCCAGGAAC | GGCAGCCGGATGAC |
| TTTTATGCTCTTAT | ACGACGACCCAGCG | AGGACGGCAGGCAG | GAGAACGCGGTCGG |
| CGTCATTCTTTTTT | CACACCGAGGCCCA | CACGACCAACCAGG | ACCACCCGAACATA |
| GCCGCAACACCCGA | AAAAGGACGAGCAA | CAGCCAGCACCCCC | GACAATAGCAACAC |
| GCGGAGCCAGAGAC | AAGCAAAACGAAAG | ACCCACGAGAGCAA | ACAAATGAGCAAGG |
| GAACCAAAACGCGC | AGCACGCCAGACGA | GGGCAAGGAGGGAC | AGATGACCAACCAC |
| CGAACACCAGCCCC | GAAGCACGCAGCAC | ACCGGAGGGGAGGC | AGGGACTGGCGGGG |
| GGGAACCCCACGCG | CCGCACAGCACGCC | GCGAGAACGCCGAC | AGGACCGGACCCTC |
| AACGCCAGCGACCC | ACGACGACACGAGC | CGAGGAGAGCAGCA | GCAAATCAAGGCGA |
| CCAGAAAGGAGAGA | CGGGGAGCAGAAGA | AAACCGAGCCAGGA | AAGACAAAAGGCTA |
| ACCCACGGCGAGGA | CCCAAAGACAGCGC | CACCACGCGACACG | TCGACCGACCGAAC |
| ACACAACAAGAGGA | CCGGAGCACCACCG | CAAAAACGCGAGGA | CAGGTCCCCAGGAC |
| ACACCCAGCGCAGA | GCCCAGCAAAAGAG | AAGAAAAGACGCCG | GCGGATCCCACCGG |
| GGAGACCGCCAACG | AGCAGACGCGACGC | GCACAAAACAGCAG | ACAGGACTAACACA |
| GCAGGGACCCCACG | AGCGAAAGACACAG | CCCCAAGGGAGGAG | GAAGGATGCCACGC |
| GGACCGCAAAAGCC | ACAGGAGGCGGACC | AACAACGAGCAGCC | AAAAGAGCCTGCAG |
| AGCCAAGCGGGGGA | AGCACGCAAGGGCG | CCAGAGAAAAACCC | GAGCGGAGCTAGCA |
| AACACCACGCGAAC | GAAAGCCCGACGCA | ACGGAAGAAAAAAG | ATCGAGCGCGCGCA |
| CGCACAGGCGGAGA | GAAACGCAGACCGG | GGAAAGCGCACAGA | GAACACCCTCCGCC |
| AGACCGGACGGAGA | CAAGCCACGCAGAA | ACCAAAAACAGACG | CCGCACGCTCAACC |
| CGCAGAGAAGAGAA | GCGACCCGGAGAAA | AAACCAACAGAAAC | CGAAGAAGTGCAAG |
| GCGGGAAGACAGCG | GCGAAAGGCGCGGA | GACGGACGGCAGGG | GTGCAAAAAGGACC |
| GAAAGAGGGGGCGG | ACACACAACAGAGC | GGGAAAGAAGCGCG | GGCCCAACCCTAAG |
| CAAAGACCGCGCCA | CCCAGAACAACGCG | CCACGGAGGCCAAA | GCAAAGAAGGTCAA |
| AGGCAACAGAGGGC | AAAACGGGAACGCC | CGGAACCCACCCAA | GAGACAATCCCCAG |
| GGAACAACGCCCAA | GAGACCAACGGAAA | AAAACGGCAAAAAG | CAGCCAAACAGTAG |
| CGCCAGCACCCACG | GAGAGCCACGAGCA | GCCTGAGGCGACAC | AGGTCAGGGACGAC |
| AAAGCGGCGCCGGC | CGGAAACGAGGAAG | CAGGGGTCCCAGCG | CAACAGCCGCCGTA |
| CGGAGGGGAAGCCG | CAAGAGAGGGCAAG | GCGACTAAAACACC | CCGCCAGGACTCGA |
| AAAAAGAACAAGGC | CGACGCGAAAGCGG | GAGAGGGGTAGGGA | GTCCCCAACGAAGC |
| GGGACAAGAAGCGA | CACGGCACGCGACA | GAGTCGCGAAGAGG | ACGGGCACAAGCAT |
| CGAGGCCAAAACAA | CAGAGCCGCAGCAA | AAGGAATCACCGCC | ACCCGATGGCCAGG |

FIG. 7 (Cont.)

| | | | |
|---|---|---|---|
| AACACGCTCCGGGA | ACCCTGCGGGACAC | GAATGCAACGAACG | CCAACACGGCCATC |
| TCAGGGGCAAGCCC | GAGGCAACGCAATA | CGCCCAAAACAGAT | CCCAGCACGTGGGG |
| GAGGAGGTGCCCGA | AGCGTAAGCCCAAC | GCAGAGCCCGACGT | ACGCATGACCCCCC |
| ACGCTCCACAGCGA | GAGACCCTAGACGA | GACCGAGGACCTGC | CCCTCCACCGAACA |
| GGCCAGGCGATCGA | GCCAACCCACACCT | AGAGTCCCAAGAAC | GAGCCCGAAGAATA |
| GGCTCGGAGGAACC | CGAACCGTCAACAG | GACCGCACATCCCC | CCAGCATAACGGGC |
| CCAGAGACCGGTAC | AACGCTGGCAGAGG | ACAGGGAGGTGCAG | ATCACAGCCGAGCC |
| CCAACGAGGGCTCG | CACAGCGGTCAGAA | CATCGGCAAGCAGC | GCCACCCAGCCTCC |
| CAATCCGACAGAAG | CACTAAGCGGCGAC | CGGACATACGCACG | GGATAACCCGCAAA |
| ACGCTCACGCCGGC | GCCCGTACCGCACA | CTGGGAAAGCCACA | ACGCATCCCGCCAA |
| CGCCGATCGGAGGC | AGCCCGTGACAAAG | CCACCCCACTAAAG | ACGAAAACAGTACC |
| AAATAACGCACCGG | CTGAAAAGAGACGA | CCGCCATCAGGCAC | TGACAGGACACGAG |
| AGGTAAAGCGACAA | GGGAACCAGCTGCC | GAAGAGAGATAAAA | GCAGGCAAAATGGG |
| CCCGAGCCTGCAGG | CACCTCACCGCGCA | GCAGCGGTCGAAGG | ATGACACGGAGAGC |
| CAGGCCACCCTAGC | GCCCCTCCGAGAAC | ATCGACCAGAGGGG | ACAGGTGCCGACCA |
| GGCACCCGGAACCT | CCGAAAGGCATAA | AGGCCTCAAAGAAC | GCCGAACGGCACAT |
| AGTGCGGAGACAGC | GAAATCCGACACCG | CCAAGCGTCGAAGC | AAGTGGGCCGGCCA |
| GGGGCACTCCCAAC | TGGAAGACGGGAGC | ACCGACAACTCGGA | GCGAACGCTGGCCC |
| CAGCTCGGACAAGA | TGGGACCACCCAAA | GGAATAAGGAGACC | GCAAAAACGACGTA |
| TCACGAAACCGAAA | CGACAATAGCCAAA | CTCCGACCACCCGC | GGAACAAAAGTGGC |
| AAGCTGGCAACCAA | GCATGGAAGGCGCG | CGACGTCCACACCC | ACGGGCAGGAAGTC |
| AGCGGGTAGCGCAC | AGAGACGGATGGAC | CAAAGCACCAATAA | CCCACGAAATCGCC |
| ACCAGGGTCGGGCC | CATAAGGCGGAGCG | GGTGCAGGGGCAAG | TCCGCAGCCAGGAC |
| CTGCCGACGGGAGA | AGAGGCCGTGGGGA | GCAAGCAGGGGGTG | TCCGAGGAGCACAA |
| GCGCTAGAGGGGCC | TGGGACCGGGACGC | CCGGGACAGACGCT | CACACCAGTAGAGA |
| GGTAGGGCAGCACG | CAAAAGGCCTCCCA | CACCGCGTCAGCGA | GCCCGAGTCCGAGA |
| GCAACGGCATCACA | TGGGACACAACGGA | CAAAACCTGAACCG | CGCGACCGCATGCC |
| CGAGAAAGCAAGTG | AACACGGTCCCACC | GCACCCATAGGGAC | CACCAAATACCCAC |
| AGACGCCTGCAAGG | GACGCTCAACAAAG | CTACACACAAGAAG | AGACCTACGCCAGA |
| CATAAAACGAGCGC | CACATGGGAGCCAC | GTGCAGAGGGACAG | CCCGAGGACTGGAC |
| ATGAACACCGACGC | CGAGAAACATACAA | CAAACCCCGATAGG | GATAACCGGGAAGG |
| CCCGGTGGAGAACA | AGACACGTACCACC | GGGTACACGAGACC | ACCTCGGAACAAGA |
| TGGACAGCAACAGA | AAGCGCGAACCTCA | CGAGGTCACGGCCC | GCGAGCGCAGATGG |
| ATCACCGGAGAACG | AGCCCAGCCTGCAA | GTGAGAACACGAGG | CCCGCACCTCAGCA |
| CACGCCTCGGCAGC | GTGGCACCAGGAAC | CAAGAGTCAGACAC | TGCAGGGAGGACCA |
| GAGCGCAGGATCGG | AGCCTAGGAGCGGG | CGAGAGTGACGCAG | CCGACAGACCATGG |
| AGCCACCATAGAAG | CAGACGCCCATCCC | CAGAGTCAACACAA | GACGGCAGTGCAGA |
| TCACGCCAACACCA | AGAAAGTCACAACG | CTAAAACAAAACGC | CACAAGAAATGGGA |
| AAAGCGTGCACAAC | AGGCAGTCCCGAGA | AAACAGGGCCATAG | AACGGCCAAGCACT |
| ACGAGCCGATGGGC | CGGTCACGACACCA | AAACCAGACCCTGC | GAAGGGCTGAACGA |
| TCCCCCAAACCAGG | GTAACCACAACAGC | CGAGGGGACAGATA | CAGCACACCATGAG |
| GTACCCGGAAGACC | AACTGGACCCACAG | AGGGACCAGGGTAA | GGGAAAGCGGAAAT |
| GCGTGACAAACCAG | CTCAAAGCGCGAAA | CAGCCTACGAGGCA | GGGAGGACGCAGTG |

FIG. 7 (Cont.)

| | | | |
|---|---|---|---|
| GGAGGAATCGAACA | ACGAGAGACAAATC | ACACCGAACGTGCC | CGGAGTGCCGGAAG |
| AAAACAGCGCAACT | GGTCCCCCAAGAAG | ACCGACCAATGCCC | GGAGCGATCCGCAC |
| TCCAGACCGGAGAA | GTAGGAAAGACAGG | CCACGACGGTACGA | AGAACCAACATGAA |
| ACTGCGCACAGGAG | GTGACGGCAAGCCC | ATGCAAGGAAAACA | GGGACCCATAGACG |
| CAAAAACCTAGGAC | AACCGAGCCCCAAT | GCAGCGCCACTGCC | AATAAAGAGCCCAC |
| AGCAAGAATGAACC | GACGGACCGAGGTA | TACCAGAGACGAGA | TGGACGGAGAGCGG |
| CAACCGCGATCAAA | AAAAGGATGACAGC | CCATCAGGAGCAAA | GAGACCACCGATCG |
| GAGGGACCCCTCCG | AGAAGATGCACAGC | GAGCGATGGGCGGC | CGCGAGCGCAACGT |
| CACTGCCCAACCAG | CGAGAAGCGCCGAT | CCGCGATGCAGCAG | AGCCCGATAAACAA |
| CGGAACGGCGAGAT | GCACGCACTGCCGA | AAAGCACCGATCGA | TGAGAAGCAAAAAC |
| AAAAGACGGCCCGT | ATGCCCCAAACCCG | CCCAAATGCGGGCC | AGTCCAGCGCCGCG |
| GACATACAGGCCGC | AAAACGCCACGATA | CAGCCCAATCCGGC | CGACCTGCCCGAAC |
| CGACGAGATAAACC | CCGGATAAGGGGCC | AGAACGAGTAACCA | GAAAAACCGTGAGA |
| ATCACACCCGCAGA | GACAAGTCGGACGC | AGGGCGAAACACTA | AGACGTCCGAGACC |
| ATGGAAGACGGAGA | ATAAACGCACCAGG | CGATCAGCGGGACA | CCACTGCACGCACA |
| CTGCGGGAGCAGAC | AAGTCAGACCGCCC | GGCCTAAGGCAGGA | CACAGAGTCCAGCG |
| AACAAAAGATCACA | GGCGTGCAACGGAG | CCAATACAGAGACG | CCTAGAGAGCCAGA |
| CAACAACACGTACC | GAGAGACCCCAATC | GAAAAGGCGAAATA | CAGGGATAGAGCGG |
| GGGCACAACAGCTA | CCCAGCCTCAGGGC | AATGAACGAGACAC | CAGGCAGCCGCAGT |
| GCCTGCAAGCGCCA | GGGAAATCCAGCAG | GCTCAAACAGCCAC | GCACGCACGTACCG |
| TGGGCGAGCCACAG | AAACACAGGCAGCT | AAGCGCGACGAACT | CAAAAGGTACACCC |
| ACCTGAGCCCCCGA | CCACGGTACCAAGG | CGCAAGAATAACGA | CCATAAGAAAGAAC |
| AACAGGCAGGACGT | CAGTGCGGGACGCG | AGAGCCGTGGGGAG | CACCTCCGGAGCAG |
| AGGCGGAATCCCGC | CGAGCGTAAGGCGA | GGACCCACGCAGTC | TGAAGCAAACAAGA |
| ATCCGAGGCCCCCG | GGAACCCTAAGGGA | ACCGTAGCCAAAGG | CCATGGCACAAACC |
| GCGCCATGGCGAGC | GGGATGAACAAGAG | GAACGCACGGGCTC | AACGGGGACCGATC |
| CGCGTGGACCACGA | GCGGTGCGCAAGGG | ATGCACAGGCCAGG | AACTAAACGCAGGA |
| CAAACTACCCACGA | CAAACCAACTGGCG | AGGCAAAAGCATGG | CGTGGCCAGAGGCA |
| GCAGCCGACCCACT | GCCGAAGGAACGTG | TACCGAGGCGGGGA | CCCCTACGAACGAA |
| AGTGGCCCACGGGG | GCACGAAGACCCTA | GGACGATGGCACAA | CTGAGAGAAAGCAA |
| ACAAACGGAGCAAT | GAGCCTAGCGCCGG | AGAGCATAGCGGAA | TCGCCCAGAAGCCC |
| GACACTGCGAGCGA | TACAAGCACACCGC | AGCCGGACACCCTA | GATCACGCACGCGC |
| CCACGAGCGGCTGC | GCCGCAAATACCAC | AATAGAGGACAGGG | CACGCACTGGCACA |
| AGGAGAGCGCTCCA | CACTCACAGCCAGC | CTGGCGACGACCAG | GGGAGCCCAAATAA |
| CAGCAAGAGTAAGA | CAGAACCCTCGCCG | CGCAACGCTGCCGA | ACACAGCAAGGTCC |
| GGGAAGTGCCGGGC | AACCACCCCTAGAC | ACCGCGATGCGCCC | AAAGGAAGAATAGA |
| CTCGAACCGACCCC | GATCGCCAAACCGG | CCGCAGCAGCGATC | CGACGAATCGACAC |
| CCGTGCAAGACAGG | TAACCAGAAACACC | GGATGAGACACCCC | GCGCTGAGCGGAGG |
| GCACGGATAAACCA | CACCTAGGCCGGAC | CACCGTAACACCCC | GCGAGAACGGGCCT |
| ATGGCAAGAACCAC | ACGCAAATGCAGCC | GCGTCGCGGAACAC | CGCAGCGCACGAGT |
| GAGCGCCTACAGCG | AAGCGGACCGCTGA | GCCCGAACAGATCC | GTCCGGACGGCAGC |
| GCTGCCCAACCGGG | TGCCAAGGGCCGGC | AGGGAAGAGCTAAA | CTGAGCCAGACACC |
| GAGGGAGAGAGTAA | CCCGAGTAGCGCGG | ACGAACCTAAACAG | AACCATCGGGCACA |

FIG. 7 (Cont.)

| | | | |
|---|---|---|---|
| GGCAGAATAGGGGA | GTCCCAGACGCCCC | GAAGCACGCGAGTG | CACATACGCCCCAG |
| GTCCAAGAACAGGC | AAACGCGCGCGGTG | ACGGAAACAGGCTG | AGGCCCAAATACAG |
| AACAAAGCAATGAG | GGGAAGCAGGCATC | AACATAGGGAAAAG | CGGGCAATCAGAAA |
| GCCGAGTCGGAAAG | ACGAAAGCATGCAC | GCGAGAGACGTAGG | GGAATCAGAGAAAG |
| ACAAGACCACAGTC | ACGCAGTGGAAGAG | GAGTACGGAAGCCA | GAAGATACAACCAA |
| TGCCGGACCCGAGC | AATACGAAAACACG | GATCACAGAAAGAG | CCGACTCGAGGGAC |
| CTGGAAGCAAGGCA | CGCGGAGAGAGCCT | GAAGGGCTGGGGCC | TGGGCGAACCCAGC |
| CCAAAACGACGTGC | CATAAGCGCACACC | CCAGGAGCCGTAAG | AGCCTCGGCAGCAC |
| AACGACAATGACGA | GGCAAAAGTAAGCA | AGACTCGCCAGGCA | ACTGCCCAGAAAGG |
| AAACAAGCGCACTA | CAGAGTGGCGCCCC | GGACAGTCCCCACC | CACCCCCACCAGTC |
| GAGGGGTACCCAAA | GCACCCTCAGACCC | GCGCCACCGAGTGA | CCCAGAGAACGATG |
| CCGACGCACGACTA | GAAAACCGCGACAT | GCAGCCCAGAACTC | CGTAGACACCAAAC |
| GCAAAGATGAGGAG | AAAAGTGGCGCAAG | ACAGGAAGTCACCC | CAGCCATACGCGGA |
| AAAGACTAGGAAAA | CACAAAGAGCCGTG | ACTAGCCCAACAGG | GGGTAACAGAGAAG |
| TGACCAGAGGGCGC | AACCTACAAGCGCA | GGCCAAGAGCATAA | CACCTGCACCGAGA |
| TCGCAGGGGAAAGA | CAGATAAGCCCGCC | CACAAAAGAAATAG | GAGGATAAGAGAGA |
| CGATGGAGGAAAAG | CAAAAACCACATCG | TGAGCGGAAGACAG | GGGAGACACCAGGT |
| GACCTCCCAGCGAC | CAACCCCACCCCCT | CGAAGAAACCACTG | CCGACAAGCAATCC |
| AGCAATAACAGGGA | CCGCGACCTAACAC | CGGAATGAAGCAGA | CCAGATGCTAAGGC |
| CACCGGAGGTCACC | AGCGAGAAATCGAC | ACCCGTGAGACCCG | AGGATATCAGAGCA |
| GAAGACTGAACACC | ACAAGACAATAACG | TACCCGCAACAGCG | GTACACGAGGACCT |
| GGAAATCGCAGGAC | GACTACACGACCGA | TAACCGGGCGGCAC | CGAGTCCGGTCGAC |
| AAAAACAAGGACTG | AACAACGCGACTAA | GAGAAACCCTCGAC | GCATGGACTCAAAC |
| GGCGGTGCAACCCA | CGCGTAGGGCAGAG | ACGGCAAGGAATGA | GTAGGTGACGCGAG |
| GGTGCCACGACACG | AAACGGGAATGAAG | GAGAATACACCCCC | GAGCGGGAGTGCTA |
| ACCCAGTGGACACC | GGCCAGCAACGTGC | AGGGTCCAGGCACG | GGAAGGCTGGCGTA |
| GCAGCATAAAACAG | GAACCGAAGGGAAT | GGGTAAGCAAGGGG | AGCAGGGGGTCTCG |
| GCAGCGAGAAACGT | ATAAAAAGCAACCC | CATGGAGGGCGAGG | TAGAGAAGGAGGTC |
| AGCGACATCAAAAC | CGGAGCACGATAAC | GGACCGAAACGTCG | GGAGGCCCTGGTCC |
| CAAGATGCAGGAAA | CAACAGTGCCCAGA | CGACCAAGCTACGG | AGTGCGACCGAAGT |
| GCGACCAGCAAGTA | CCAGGCCACGTCGG | CGGAAAGTGGAGGA | CTAGCAGCAAGCTG |
| AAAACCTACGAAGG | CGCGTGCCCAGAGG | CCAGGGACCGTGGA | AGTTGCCAGAGCGG |
| AAAGGATGAAAGCC | CACCGCACACATGG | CCGACGCTGGAACC | CTACCACGGGGTCC |
| TCGAGGGCACGCGG | GAGGTCAAGCAGGG | ATAAAAGAAACCCG | TAGTAAGAAGGCAC |
| CCACAGACTCCCAC | ACCCCGACTGCCGG | GGGAGACACATAAA | CGTAGGACGGCTGG |
| CACGAGCGAAAGTG | CACCTGCACACGAC | GCGCGTACACCCAG | AGTCGTACCCGGCC |
| ACCGGAGGGAGCTA | GAGAAAAAGAAATC | AGGACCATAAACCC | TACCGCCTGGCACG |
| GGACGTCCGGCAAG | AAGCGCAACCCGTG | GGGGTACGCCAGCA | GTTACACACGGCGC |
| AGCACACGCTGGCA | AAGAGATAGACGAC | AGGCCCAAGAGCCT | TGCATACCGCGAGC |
| TAAACGGCGGGCCG | GCATCGAACCGCGA | CGGAATGAGAAGCG | TCAGGCGAGGGTAC |
| GCGATGGAGCCCGG | CATGGACAAAGACG | ATGCCGAGGCACGC | AGCAGTACCGTCAG |
| CGTCAAGAAACGCC | CGAATAGAAACGGA | GGGAAAATAAGAAC | CGGGAGCGATAATC |
| GCATACCAGAAACG | TCAGAAAGGGCACC | CAGCGCAAGACTAC | CCGGTACCGTAGGG |

FIG. 7 (Cont.)

| | | | |
|---|---|---|---|
| ACCGGTATGCGAGA | GTGTGCACCCGGGC | CCGGTCCATGACAC | TGGAGGATCACAAG |
| AGTCACCCCTAACA | CGCTCGCGAGATGG | CCGTCGAATCGGCA | AAGCCACGGTATAC |
| ACGAAAACCCATTA | GAGAAGTTACAAAG | CCGAGTAACGCTGC | AAGGCTGGAGCCCT |
| CTACCTGAAGAACA | GAAGTCACAAGCGT | CCGCTGATGGACGG | AGTACCCGTGCGAG |
| GCAAGTCGCGATCC | GCATAGAGCAGGTC | CGGTGTAACCGCAG | GGAGCCTACCCGTC |
| TGGCACCGAAATAG | AGTTCGCGGGCCCA | TGCACCGAGCTGAG | AATCACGGGTCAAG |
| CCCTCGTGGGGACA | AGTCACAAACTCAA | ACGTGGCCTGCAAA | ACAGTACGAGTGGG |
| GGATCTGCAACACG | GAGGAGCGTACGTC | CGCCCACACTTGAC | CGCGAGACTTAAGC |
| GTGGACCATAACAG | TCGGAGCGGCTGGC | ACAACTATCCGAAC | GTAGAGACGCCTGC |
| CGGCTGCCAAGGCT | CGCGATACGCCTGA | TGACTACGACCCAC | TAAGCGAAACTGGC |
| CGACTCATACAACA | CAACGGGCTAGTCA | CGCGCAGCTCATAC | AAACCCAGATTGCA |
| GTAAGCTAGGGAAG | CCTCCATCGAAGCC | CCTCGAGGTCAGAG | ATCGAATCGACAGA |
| ACGAACGGAGTTCG | TAAGGTGAAAAGGA | TGCCTCCAGGACCG | AAACGTAGACGTAG |
| ACACTGGGACGAGT | CCTACCTAACCCCA | ATGCCGAGGTGGCA | TAACGGCACTACAG |
| AGCATGATGCCGCC | CTCGTCGAAACAAG | GAGTATCGCCAAGG | CGATCACACGGGGT |
| GATCCAGCCGGGTG | AGGATAAACCGATA | GCATCTCGCCCCAA | AAGCTAGGGCGTGA |
| GTCGACTCAAGGGA | GACACAGTATACGG | GAGGATCGATGGCG | GTAGGTAACCGAGC |
| AAAGAGACCCGATT | ACTGACCAGCTACA | ACATAAGTGGAAAA | GGTCAACGCCTGCC |
| GGCAGCTCTGAAGC | TCATACGACGAAAG | ACGACAGCGAGTAT | GATCACGTCAGACA |
| CCGGTCTCAGCACA | ACGCGACGTTGAGG | CCGACACCCTCCTG | CAGCATGCTGGGCG |
| GACAGGATCAGTCC | CAGATAAAAATCGA | ATCCCACGTCACCA | CGAGCTAACGATAC |
| CCGATCGAAATACG | GGTGTGAAAGGCAC | AGAACCACCCGTTC | GCTGGAAACGTCCG |
| GCCGGTCGATCCAA | AGATACGCCAGAGT | ACACAGAGCTCTGG | GGGTGAGGTCAGAC |
| GACCAGCTCCTGAC | AAGGTCCCGCATCG | GAAAAACTTAAGGG | GGTCTACCGCAGAG |
| ATTAAGAGAACGAG | AGTACATAGGCGGG | GGGACGCCGATAAT | TTGAGCAGCCAAAC |
| CGTACAAGGATGGC | CCGCGTGAACGAAT | CGAACTCAGTAGCC | ACCCCGAGAGTGGT |
| TAGTCGCCAGCCAA | CTCGAGGGTCGGCA | GCTAACATCCAGCG | GCCCCACTACGTCA |
| GCCCAAGTGATACA | TGAACACATACCGA | TGCCCAGGTAAAGG | CTAGACCGATGACA |
| GAACGCGGTGTAAG | GACTGAGCTCGCAC | ATATAGGAACCGCC | AGCATGGAAGGTGA |
| GGCTAATAAAAAAC | ACTGGAAGACGGTA | GAGCTGGGATGCGC | TGCGCCAATACAGA |
| CAGACGGCACCTTA | AAGCCGCTACCCTG | ATGCGTCGCCAAGA | CGCCCTTCACGGCA |
| AACGGCGTTGACAC | GCGACGCTAGGGTG | GGAATGCCTAAGAA | GTGGTCGCGGAGCC |
| CCATATGGAGGCGC | ACCTCCTAGGAGGC | AAACGCCCAGTATA | GGTTGACCACAACC |
| GTAAGTACAAGGAG | TCTGGGGGAGGGAG | ACTACCGCACGTAA | AGGAGAAGATTGGA |
| GATGCGACCCGTCC | GCCGATGACATGCA | CCGGTGAGAGGTAA | CTCGTCGGCGAAAC |
| GCTGGGTAGGCCGG | CTCCACACGGACTA | TCGGCCTCACACGC | CCCATAGTACCACA |
| ATCCCCTCCGGGGA | ATAACCGGGGGGCT | CATGAAAAGCACCT | AAACCGAGGCTTCG |
| TAGCCCTCACGCCG | ACAAGTAAAGTAGC | GCATGCAGGGTAGC | CGCATCGGGGTGCG |
| TGCGCGAGAGAATG | ACCCGGATATCGAA | TACGCTGGGAAGCA | GTCCGGACGCACCT |
| CGATCGAAAACTCA | CATGCCTGGAGGCG | ACTACCAAGGATCA | AAGAAGGTCACGTG |
| GACACACCAGCGTT | ATAAGTCGACGACG | TACGAGTAAGGGCC | CCCGGACAAGTGTA |
| GAACCACCAAGTTG | AGCCTGCGGTGGGG | GTCCTACAACACAG | GCGAGCTCAACCCT |
| CGCAGCGCGTCATC | GCGTGCGCAATAGA | GTCACAAGACCTCG | CAAGACGATCAGAT |

FIG. 7 (Cont.)

| | | | |
|---|---|---|---|
| AGAAAGCACGTCTA | GCGCTCGCACTCCC | TACGGCAGGCACGT | TAGGAATGGACGGA |
| TAGGACACGGGCTA | ACTCACCCGTGGAG | CCGAGCATACCTGG | CCAACTATGGAGAC |
| CTGAGACCTGGAGA | ACCACTCCAAGTCA | AAGCTGTGGAGCCA | TGGAAAACACGCAT |
| AAAGATAAGATGCC | GTAAAATCACAAGC | ATGGGGGAGCTGCA | AAAACAAGATACGT |
| AAACAATCATAGGG | GGAAACATAACTCC | AAGGGACGTCATAG | TAACGCTGGAAGAA |
| GAGAGGGTGTCACC | GTGCGGCACAAGAT | GTGGAGAACCGGTA | GACGCGAATAGATG |
| CTCAGTGGACGCGC | AACGTATAAAGAAC | CGTACTAACGGACC | CAGGGCGATTCCGA |
| CCTTAGGCGAACCA | GGAAGGAACCCTGT | CCGTAATAGAACCC | TCACGCACGATAAA |
| GCCCCTAGACAATG | TAAGACGGGTACGA | GTGAACATGCGCGG | TATACAGGGGGAGC |
| AAGGGAAAACTATC | CCGCACCTGCGTCG | GCAAAAGGTGAGTG | CGGTCTCCGGAAAA |
| GGTATACCGACCCC | TACCCCTGCACCAG | GGACCGCACTCTCA | GGTCATAGACCGCA |
| TACCCTAGCAGAAA | GTCACGAACCGCCT | AACAGCACCTACTA | CTCGGGAGGTCCGA |
| GCTGACCACGGCTA | CCGCCACTCCAGTG | GCAGATCATAGGGG | GTGAAGGTGGGGCC |
| TGCGGCAAACGGGT | CTGCAAGGTCGCAC | GCGCCTTCGCACGA | AACTCGAGGAACTG |
| GCGTGGCACGTCCC | CCTCACGGCCTGGC | AATGTGGCACGACA | GTAGGGACGGTCCG |
| CGAACGCTGCGCTA | TAACCAATAGGAGG | AAAAAGCGTGCATG | ACCAGGCCTTGGAC |
| GGTAGCGGCACACT | GCAGGAGAGTACAT | ACCGATAAAGATAC | AACTGGTCCGGGAC |
| TTAGCCGCAAAGCC | GACGAGAAAACCTT | CCGCACTAGAGACT | AAGATCGGCGTACC |
| CGGCCATATGAGAC | AGAGCCACCAAGTT | GCCACTGTACGCAC | TCCCGAGCATCGAC |
| GGTCGGCCTACCCA | ACTAAGACGCAATC | GCGCTGGCGAACGT | GGCCAGTCAGTGCA |
| CATCCATCCCCCAG | CGTGGAGGCCCATA | GCTCCCGGATAACA | CGAGAATCGTGGCA |
| GCCGGATCGACCAT | CGGGGTTAGGCGGC | AACCTGGTCCAGAA | GGAACTAGCGTAAC |
| ACCCCAGGCTGACT | CACGAAGTCACGTC | CTTACCAGCAGCCG | GAAACTATGAAACA |
| AGAGGGGAATCTCC | GGCCTGTACGGGAC | CTGCCAAGGCAGTA | TGAAACCCTGACCC |
| CAATGTGAGGAAAG | CAATTGACGCACAC | AAAGCCTTAGGCAC | CAGAGCTGCCCATG |
| CTGCAGTCGCACCG | CTCACGGCTCACCC | GGAATTGCCGCAGG | ACCGGGAATCGGAT |
| AGTAATAAAAGCAG | ACAAGGGGAGTGTA | ACGATAAGTGGAAA | GCTATCGCGAAGGC |
| ACCACGCCGTCTGA | ATGGTCACCCCAAG | CGGCAAGTAATCGG | GACAGATAACTGCA |
| AAGCTCAAGGTAGC | CTAGCCCTCCGACC | CTACGGAACGGGAT | TGACAAAGAAGCTG |
| GGTCGAAATGACGA | ACACTATACACCAC | CCCGGAATAGCTAC | GGAAGAGTCGTGAG |
| ATAGGCAGACATGG | ATAAGCCATGCGGG | CCTCACCGAGTCCC | GGCGCTATGGGAAA |
| TGGCATACCCCCCA | TGTAGACAAGAAGG | CCGGAGTAAGCTAG | GAAACCGACAATCT |
| AGCCACTACGCTGC | CCCACACCGCTTAA | TAGAACGGAATCGC | CCCCTCTCACACAG |
| AGCCCCAAGTGGTA | AACCATCCAACGTC | AATCGGGCGGCGAT | CTAGGACGAATGAG |
| TAGGACGTGCGACG | CATGAGTGAAAACA | CGAAGCCGTCAATC | GGGGTGAGGACCTG |
| CTAAGAATCCGCGC | AGGCTCCGTCAGAC | AGCGGAAGCAGATT | CGTCCAGTGACCCA |
| CTTCGAACCACCGA | AACGCCTAACTCGG | CAGTGTGGGCACGA | GGACGCGGAAATAT |
| GTCACTACCCCGAG | AATCAGTACGGGAG | CGTGACGGGTGCCC | AGAAAAGACCTTGG |
| GCAGGAAGCTGGGT | CACCTAAACGGCGT | GTAAGAAAGCTCGA | AACCGGGTGAATGA |
| AATACGGCCATAGA | CCATAGAAACTAAG | AGACTACTAGCAGC | CGCACGGCCTACGT |
| TCAGGCCTCGCGCC | GTCAGTGCACAACG | CAGCGCTATGGACG | GACCACATGGTGCC |
| GGCCTCAAGCGTGG | TGGACCGGTGAGCC | TGGAGTAGAGAACC | CACGAACAGTTGCC |
| TCCCGCATCGAAAG | GATGGCGCTAGCAG | AATACACGGGACTA | CATCTACAACAGCC |

FIG. 7 (Cont.)

| | | | |
|---|---|---|---|
| GAGTGTGACCCACC | TATCAGAGCACCAC | GAACCCGGTAGGGT | GACATAAGTACGGG |
| GCCTGCATAACGAC | CACTCCAGCTCGAA | TTCACAAAGGGGGG | CTAAGGACAAGTGC |
| AAGGACCCTGATAC | CAGAGGCACAATTC | AGGAGGCCTCAGAT | ACTCAGCAACGGTA |
| GATAGTCGAAAAGA | GGGTAGCTGCGCAC | CCGAGCCGTGGTCG | GGCACCGGTCGTCG |
| GCGGGTCAACTCGC | CGATCGCAGGTAAG | CGAATGAATGGGAC | GTTCAGAAGAGGCG |
| CGTTGAGCACACAG | CCACGCTTACGCCG | CCACAGGTTACCCG | TGACGCTACGGGGG |
| AGTCGCGAGGACGT | GAACCCTCCATACC | GTCGCACAAATGCC | TCCGCGTCACGGAG |
| CAGGACAAGGTTGG | AAACATGCGAGGGT | GCGCTAAGAAAACT | AAGAACTGCACCTA |
| ACGACGGCTGATCA | GTGCGTGGGAGAGA | TCGTGCCCCAAGGA | TACAGCCATGACAA |
| AAATCATGACAACA | TACAGAGGCCTAAA | TTGCACCCAGGAGA | TGCCCTAAGAACCC |
| CGGCGTACAAGCGT | GCGGCAAAGCTTGG | CGGACGAGTAAGGT | CGAGCACTGAGTAC |
| GTTCGGGAGACAAA | TGGACATCGCGAAA | GAATCAGGGGAGGT | CGCTAAACACTGAC |
| CTCGTCAGAAGGCA | AAGATTGGACGAAC | CAAGCATCCAATAC | GGCTATGGCCGCGG |
| ACGATGAGCGTGCA | AAGACTAAGAAGTA | ACACTCGTGCACAG | TTGGCGCAAGAAGA |
| GGGACCACGTGTGC | TGGAGAGAGCATAG | CAGGCGTGCGTGAC | TCTACCGCCAGACG |
| TACAGTGACAGACG | CTGGGTAAAAGGGA | AGGTCCGGACGTGA | GCTATAACCAGAAC |
| TAAAGGACGCGAGT | GACTACCGAGGGGT | GCTCGCCCAGGTGC | TAACGATCCGCGCC |
| GTTGAAGGAACAAC | CCCAGCACGCACTT | GATCCTCCCAAGGG | CCAAGGCATAACAT |
| CGAACTGGATCGAA | GAATGGGACCGTGC | CGTGCGCAGAAATA | TGCCCGTGCAACCA |
| AAGTTCCACCCAGA | CATCGAAAGATAAA | TAGTAACCGAAACA | ACATGCTGGCGAAA |
| CCTAGGGAAACACT | AGTAGGCTAGAGAG | TAATGGGCACAGAG | ATAGGGAATAAAAG |
| AACAATCATGGGCA | CGAGTATACACACA | AACTCCGACCACAT | GGGAATAGTGAAAA |
| CGGCTGTAGGCAGA | AGGATTGAGACCGA | CGCCAGGTGGCATG | GCATCACCGGCAGT |
| GCACGTCACCGGTA | CTCACAGCGGCCAT | ACTCGGAGTACAAC | AAACCGCCGGGCTT |
| TAGCGGAGGGATGC | TCTGAACGGCAACG | GCCTATAAGAGCAC | TGACACAATCACGC |
| GAACCCACCTCCTG | AATCGGGACTCAGA | GCAGGAGGATGTAC | TAACGGTGGACCCG |
| CCAAGATGAAACTA | GAAAGTGGGTGGCC | TCATACGGACAAGA | CGACAAAGGTCAGT |
| TCCGTGCGCCAACA | CACTCGACGCGTAG | AACGCGCTGTGCGG | GAGTCGAGCACCTC |
| GACAGCGAGGTTAG | GCCTATGGGGCGGG | AACTCAGCGATCAC | AGATGGATACAGCA |
| GAGATGAGGAATCC | CCTAACTACGGAGG | CCCCAGTAAATGCC | GCAATGCCCAGAGT |
| GCCACCGCGTACAT | AAGTCTCCCGCACG | TAACGAGAAAACAT | CTCACCCACCCGGT |
| CTGACACGCCGTCG | TCGGCCACCAATAG | CCCCTCGGGTCAAC | GCACATCCTCACAA |
| CCACTAGAACTACC | GAGAGCTGGCTGGA | CGACTCTCAACCAC | GTCTGGAAAGCCCC |
| CCCATAAATAAGAC | AATGCGACGCACAT | CCTAGGGGCAGTGC | GAAAAGTCGGCAAT |
| AATCCCGAGCGAGT | GCCCACACGTGTCC | CGCAGGGTGGAAAT | GTGTGACCGGACGA |
| TTCGGACCCAAGAG | GATAAAAATACCAG | TAGCCCCACCATGG | CCGGTGCACCTGGA |
| CTAGGGGCACACTA | GTCACGCTGGGAGA | GACGAAGGTTGACG | CGGGACAGAACCTT |
| ACGTCCGTGCAACC | AGGCAGTATAAGCA | GTAGAGGGACTCGA | AGTGTAGCCGCCGG |
| ATGGCGCAGGGGAT | TACAACATCGAACC | ACCTGCCGAGTAAG | GGTGCCACCAGTGA |
| GAGCCGTATCGAGA | CCGAAGGGTATAAC | CGCTAACGTACAGC | TCAGGCCCAGACAT |
| AACCTGGGAATCGG | GTTGAGGGCCGCAG | AGCGGATGCGCTCC | GGGTCCCCAGACTG |
| ACCCGACTTGACGG | GCCAACTGCAAAAT | ACTACCACCACAAT | ACTGGGGAGCAATG |
| ACGATTAGGCGGCC | CGGCAATCCGTAAC | TGGACGGAAACGAT | CCCCGTCAATGCCA |

FIG. 7 (Cont.)

| | | | |
|---|---|---|---|
| CTCGGCACACAATC | CCGGGTCTACCGCA | GCCAACTACACTGG | GGCCCTGTCGAACG |
| AGAACCGTCCTCGC | GCTGAGTCGGGCCC | CCCTCGACTAACCG | CAACTTGCGGCGGG |
| ACAACGTGCATCGA | GGCTAGATAGAGGC | AATCCAGCTAACGG | AGTCCACGACGTCC |
| TACAGCGCAGGCTC | GAAGCAGTGTCAAA | CTGAAGGCGAGCAT | ACCTCGAGGTAGAA |
| CGGGTAAGGAATAC | AAAGTGCCATACGC | CGGCCAATCACGTC | CCTAACCGGAAATC |
| ATTACGGAAAGGGC | TCGATGGCGAAACC | ACCTCGCTCGCCGC | CCCAGCCGTGTCGC |
| CAGATGATGGCACA | CCCCGACTGCTGGC | GGGGCACATAATCA | CCGGTCGATCGAGA |
| GCAAAGGCGGTTGC | AATGGCACAGGTCG | CGGTACACCAAGGT | CCTATCGCCGACGA |
| TACAGGAAAGTGGG | TCCGAAGCGTGACA | CTCCCATGCGAACA | GGCGTCTGACGCGA |
| CTCTGGAAGCGAGG | GATATGAACACAGA | GGAGATGAAATGAC | GAACTCGGGACTCC |
| CGAGTAGGAGCCCT | CCGAGCTCGGCAGT | TAAAAATCGCAGAA | GAAGCCGAGCTTAC |
| TCCACCAGGCTCCA | GACGGTAGAAGTCA | AATGAAAGTAGAAA | GAATGCCCGAGAAT |
| TCTACAAAACAAAA | AAACTTAAGACCCA | GTATGAAGCGCGCA | GGGAACATGAACAT |
| CACCAACAGATCTA | GACCCGGAGACTAT | TAGGGCCTAAGAAG | TGATCACGGCAAGA |
| GCAGTGATGCCGCA | CGCACGACCATTAG | GGATGCGTACGCCC | CCCATCCCCTAAAC |
| GGGCGTTGCACACA | CAAAATCATCAAGA | AAGGACGTATACGG | GGAATCGGAGGTCC |
| CGGTCCAAGGCTGC | GGTCTACGAGCAAA | CCGAAGGGCTCATG | TACATAAGAGGAAC |
| GCCGGTGAAAGTAG | TCACCGCAGAGATA | GTACTGAGCAACGG | AAACTCATCACCGG |
| ATAACGAAGCCGGT | TGGCGAGCGGCATA | CATGAAATCCGGCA | CCCGGTACAATGAC |
| CAATCGAGTCGGGG | GTTGCCAAACAGAA | CGTATAAACGAAGA | GGCTACCCGCTCGC |
| CTCCAGGCCAGCTG | CTGGTAGGGGCCAC | AGTAACTGAGGACG | ACTCAGCGAAACTG |
| ATTGGGACCAGGGA | GAAATCGACTACAG | CGACGCGTCCGTGC | ACTGTCACGGGGGA |
| CAGACTGCGGATAG | TGACCTCAGGGGAG | CCTACCCCAAACTA | AAGGCTGCGTGAAA |
| CGTAACAGGAGGCT | ACACGTGTCGGGGG | GAGTGCAGAGTGCC | AGTCTAAGACACCA |
| AGCCAGTTGCCGAG | CCTCGAGCATGACA | AAAGTCGGCAGCTG | ATCTGGAGGGAGCC |
| GGACGACGATTGAC | CCCGCTTAGGGAAG | TCCGGCATGAGGCG | CCGGAGACATTGAA |
| AATGCATACACAGA | TGTGAGCCGACACC | GTCGGGAAGAGGTC | GGAGACCCATTCAC |
| TCGAACATAGGGCC | GGCGGTTGGGAGCC | CCTGTACGAAACGG | CATCGTCGGAACCC |
| CGACGATCGGCCAT | GGAATCGAAACCAT | TGGAGGCCAATACG | AAAATAGGTGCGAA |
| CAAAAAGCTACATG | ACACTAGACGATCA | ATGCACCCGGAGAT | AAAACCAGATCTAG |
| AATGGTCAGCCGGG | GACTGAGCGCATCG | CTCGCCAGCATCGA | CGCACCTGAAGGAT |
| GGGGTAACCATCAA | ATAAGGGGATGCCC | TGCTCCGACGGGCC | TACTACCACCGGGC |
| GATCGGGATCCCCG | TCACCAACCGGCTG | GTACGGGTCGAAAC | TCTCCGCCAAAGCA |
| AAGGGAGTCCATGA | GGTTCGGCACGGAC | GAAGGAGACGTATA | TACCACCGAATACC |
| TCGGTGCGGACCCA | AAACATGGATCAGC | CTCACGCCGAGTCG | CGCGGATAGACATC |
| CAGGAGAGCCTTCC | AGCAAGTACTCCAG | AAGCAATGCGATCA | AAGAGTCAAGTGCG |
| AAAGAACGGCTTGC | ATCAAGTCCCGCGC | GAGGTCAATCGACC | AAAGAGATTACACG |
| CATAACATCGCGGA | GACGCTGGAACCTC | AGGACGTACCAATC | GCAGACCACGCTAT |
| AACCAGGCATGCCT | AAAAGCGCAGATCT | CGTCCAGCATAGGG | CACGCTGTGCGGAC |
| CGCAAGCTGCTAGC | AAAGTCAACTAACA | CAGCAAACTGCATC | CCTCGGAGACCTCG |
| GCTAGATGCAGGCG | CTAACTAACCCCCG | TGGGTACGGGGACA | AGGGGAGCATTAAC |
| GGACTGGGTAGCCG | TAAGCCGTGACCCC | ACTACACTACCGCC | GCATTGGACGGGGG |
| CGGTAGCACAGTAC | ATGGCCCTGGGCGA | CGTCCGCAACTCGC | TGAAAAGAACAGTC |

FIG. 7 (Cont.)

TAGCACTGAGGAAG
TGGGCATCCACGCA
CCTAAAAATCAAGC
GTCGTACCCCCACA
GTGCGAGCACGGAT
CAAGATGGCCACTG
CGTCGAGCCTCCAC
GAGGGTTCGAGAAG
CGACGTGAGACCTA
GAGGCCGATGATCC
CACCTCCGTCCCCA
GAATGGAGCTCGGG
ACTGAGTGGCCCCG
AGACTAGCCACATC
CACGATGATCCACA
ACAACCGTACAATA
GAGAGCGGTCGCTC
CCAGGCCAAGCTTC
GTGACGTGCCCGCG
TGGAACAGCCGTGG
CCCAACTTAACGGA
CATCGAAAGGCCTC
GAAGCTAAAACAGT
ATGCTCCCACCCGA
AGCACAGTGTGGAC
GGCTGAGACGGTGA
TAATGCGCGGCCGC
TGCCACGCACATCG
GCCTGTACCAGGAA
GCGGGTACACGTCC
GGGACCGAGCAGTT
TGGGGCAAGGTGAC
CAAGGCATCTCGCA
AAAGTGAGCCGTCA
GAATTCGGCACCAA
CGAAGTAAGGTAAA
AAGACCGTGACGAT
TACACGACCTCACA
TTGCAAGGGGGCGA
GACTAAACAGCCCT
CAACAACACTAGTG
AAGGGAAATACTGA
AGACTGGTAAAGCG

ATGAGGGCCTCAAG
GGGAGGTCCTAAGA
TTGGCACAGACCGC
CACTTGACAACCGC
AACATACGCAGCGT
CACACAGGCAGGTT
CACCCCACGACTTA
GGGCACTGTCACAG
CTATAGCAACAGGA
CTATAAGCGCACCC
AACGAGCATAGAGT
AGTGCAGCGTACCA
CTAAGGAGCGTACG
CGTTCCGAGCCGAA
GGATAAATACGCAA
CGTCCCGAGTAACG
TAACGTCCCGGACA
CTACCCGACCTGAA
GATAGATAAAACAA
ATACCGACTGACAA
TAACGCTCCCCCGG
CACTCTAGCGGCCG
AAGGGAGCGATTCG
GACCGAATCGAGGT
CACGTAAGAAGCTC
AACGAGGGATACTC
CAGTCACGCGCCCT
GCAAAGTGCTCCAC
GCACGCAGACGTCT
AGAGCGCGATGCCT
AATGAGCTCAAAAA
AACCTGAGCGCCTC
CCCCAGTGGCAATA
GACCGCAGGAATTC
TAGCCACAGCGGTC
AAAGTCAGGCACTA
CGACCAGGGCTATA
CCATAAGCTCAGAA
AGGCCTAGAGACTC
TAACAGGGAAAATG
TACGGAGGAATCCC
CACTGGGTAAACGG
CTTAGCGCGCGGCC

GGCCACTAGATGGG
CTGAGCGCTCCCGG
AAGCGTCAGCCCTC
CATAGCCACCTCGA
GACTGACATCCAAG
TACAGACAGATAAC
GCAACTATCAGCGG
TGCGGACATAGACC
CGAAGCATGAAACT
CAAACAAGGAATTA
GGAATATGCAACCA
AGCGCGAAGTATCC
CTTCGAAAACGGAA
AGGGATCAAGTCCA
CATAGAGTAGCAAG
GGCTAAGAAACCGT
GAGCCTAAGATAAG
ACTCCCTAGCGCAC
CTGGACCCCCTGCG
TAACACGAGACTGG
CCCATAATCGGGAA
CGGTAAGGGTACGG
CAATGGCACGCTAG
GATAGAGTCCCAGC
CATCCTAGACGGAC
TTACCCAACACACG
CCACCAGTATCACG
AGCGACCGTTCGAA
AAACACGTTACGAA
GAAAGCCAGGCATT
GGGGCTAAGAGTCC
ACAGAACGTCGTCA
GGCGCTCAGCTAGC
ATATACCCGGCGCC
GACTACAGGCTCCG
ACGTACTAAAGGCC
AACCGCCAGTGTAA
CGACGTGGCGTGCA
TCCAGACGCCCACT
CTAGGGGGTCAACC
CGATAGAACTAGGG
CGAGGTAGCAAAGT
GCGGAAATCAGACT

CCCACCACCCGTCT
TGACCGGGTCAGCA
CACTTAAACGCAAA
CTCCCTGCCACCAA
CGCAGGTCCATGGC
GGTGTGAGAGCGGG
TGAGAAGGCGCCTG
GCATAATGGCCGAG
ACTGCCGGTGGGCA
GAGCAACGGGGGTT
GAGTCCACTGGAGG
CCAGTTCCCCAAAA
CGAAAGGCATCAGT
AACTAGACAAAGCT
AAAAACCTCGCTCC
GCCGTAGATGGAGG
CTACCGATAAAAGG
GAACTGATGAGAGG
GAATACTCCAACAC
GACATAGATAAACA
AAGCCGGTTAGGCG
GCCATCCAGCGGTG
ACGTGCGACCTGGG
AACCCTCGAGGTGG
AGGCCACCGCTCAT
AACACGCATTAAAC
CCCCCATCAACGGT
TCATAGCCAGGGAA
AGTTAGGGCCGCCA
CGGAATGAATGGAC
CGAATAGGGCGAAT
ATTGAGAACGCCGA
TAATCCAAGAACGC
CAGGGCCTTAAGCA
TGAGGTACCGGGAC
AAAGGCTTGCCGAA
TGGCCACGGCTACG
AATCGTGCGGGAGA
AGGGGAAGCTACTG
GTCTCGGGGAGGAC
ATCAGTGGGGGCCG
CCCCTGGGAGAGCT
ACAATACAATGGAC

FIG. 7 (Cont.)

| | | | |
|---|---|---|---|
| AATCGAAAGTACCG | GCTCAGAACCGGAT | ACCTCAGGCCTGAC | GGTCCGCACTGCAC |
| GCCGTACCAAATAA | CTAGTGGGCAACAA | CTAATAGACAAGCC | GGTTGCGACGCGCG |
| ATAAAGCTGAGCGA | CCTGTAGCCCCCCA | CATGGGCGAATGGA | CCTCGGCAGGTCAA |
| AACTCCGGAGGTAC | TAACAGGATGGCCA | CCAAGACCTAATGA | TGCGTGCCCCACAC |
| TCCCTAGCCGAAAA | CGGGAACTGAGAGT | GAGCCGACTGAACT | TCGGAGTGACAACC |
| CGGCTGCACAGCTG | CTGCGCAGCCCACT | TAACTGCAACGACC | TGGCGCAACACGCT |
| CTGCCAAACTACCA | CCGGACATAAGTAC | GAACGATAGTCACG | ATAAACAACGATAA |
| AAATTGCGCGAACG | GTCCAACATGCACA | TAGCGTGGAAAAAC | CACGTCCCCATACA |
| AGGTAGCGAGTCGG | TGACAAGTAGAGAA | CCACCAGACGCGTT | ACTCGGACGGACTA |
| CGAAACGCGCTTAC | TTCGACGACCGGAA | AAATGAAGTAAGAA | CCTTGACGAAAAAC |
| GCATACAACTCCCA | CGACTGCCACCCGT | AAGAACCTATGGCA | GCCGTGATCGGCCG |
| CGGACGATCGTCAC | AACTAACTAAACGC | CAGTCCGACCCCTA | AATAACCAAGTCGG |
| CTGGCAGCTGCGAA | CAAGAGAGGTGGGT | GAGAGATAGGAGTG | CCCTGCGTAGGCAC |
| GCGAAATCCTACCA | TCGGTCAGACCAGA | GCTCAACAGCGTGG | CTAGGACAGCGGGT |
| ATCCCCAGAAGTGA | CGGATCGAAGGAAT | GGCAAAGATATAAG | AGCCGGTTAGGCCA |
| TAACAACTGAGCAC | CATGAAACTGCCGG | CTCCCAGATCGAGA | AACTATGGGCGGCA |
| CGACCCAAGCTGGT | CGCATTCGCCGCCA | GGACTCCGTGACAA | ATGAGGAAAGGGCT |
| GCAGGGGGATAATG | ACTAACCTGCCCGG | GCATAATGCCGCCA | CGATAGATGCGACA |
| GGGAGTCGGCCTAA | GCACCGACCTTGAA | GGGAGTCCGTGGGA | CTGAACACTACCCC |
| TATCAAGCAGAACA | ACTGCCCCAGTCAG | TAACGACAGCTACA | TGAAACACGGTGAA |
| CCGGCAAATACGTG | ATACCCGACGGTCG | AAAACTCAGACAAT | AATATGGAACCAGC |
| ATAATAGGGAAGGA | TGAGCCTAAAAAGC | ATCCCCGACGCATA | CAGTAAGGAAGGTC |
| GTGAGATGGAACGG | GATCGCGCACTAAA | CATGACGCAATACC | TAACCCGGTCCGAG |
| CCCAGTGAGCGGGT | TAACACGGCCGCTA | ACACTGGCGACTCA | CTGCCGTACGGGCC |
| AAATGCTGGGGCCG | TCGCGAGCCCACTA | CCCCGACGTAGCGT | GTGAGGACGGGTAA |
| ATGTGGCGGCCGCG | GGCCCTGACACCTG | TCATAAGAGAAGGA | CAGCCTCAGCAGAT |
| TCCTCCAGCCCGCC | CGATAGGGAAACCT | GGATGCAAATCCAG | CACTCAGCCTCCGC |
| ACAGCATAATGCCA | TGACTCCAAAGAGA | GGCAGGCTCCATCG | TGAAAAGGTACGAC |
| TGGCGAGACCTCGG | GCGCCATTAGACGG | AGCTAAAAGGCTGA | GGGTCCCCACTGGA |
| GATAGACAGTGGGG | CCCCAAGGATAGTC | ATTAACGAGCCGGA | CACAACGCGCATGT |
| GGACCCGTTGACGG | CAAAGTGAGCGTAC | TTAAGAGACCACAC | ACGATGGCGCGCTA |
| GGATGGAAATGACA | CCATAATACGCGAC | GGTATGGACCGGCG | GTAGCGTAGACGCG |
| CCTACCACACGGTC | AGGGGTCTAGCGGG | TAACGAAAGTGAGC | CCACCACAGATAAT |
| AACGGAAGAGAGTT | CGGACAGAGATCTC | AAGAATTCGACCAG | CGACGTGGTAGAAA |
| GAGTACGTGACCAC | GTACAGCACGTCAG | ACCCGCACCTTGAG | GCGCACGCATGCTG |
| GAGACTGCGACTCC | AGGCACATGGTGAG | GTAAGAGGCAAGAT | CGTTAGCGGCAGCC |
| CCCTGCGCACGTCG | TAAGAACAATACCA | AAGCCAGATTGGAA | TAGGATCGCCACCA |
| GGTGGAGAAAGAAT | AGAGCTAAGATCAG | GGCCTTAACAACAA | TCAGCCCGACCTCG |
| GTAACGTCAGCGCC | GCTCCACGTAAGAA | CCTGGATGGCGCAA | CGAAACGAGTTCGG |
| GGGCAGGCATATAA | ATTGACAACGAGCG | CAAATGACCATAAC | CCCCGTCCTCCAAC |
| GCAGCGGATCTGAG | CCACAAGATTCCAA | TGCTCAAGCGGGAA | GGTGACGTGAAACC |
| CTGACTCGGGCGGA | ACACCTCGGTGCAA | GAAACGGTAAAGGT | ATCTACACAAGGAC |
| CTGACCTGCAAAGC | CTGAGCCAGCGGTA | GCATCAGAGCCATA | AGCGAAATGTCGGG |

FIG. 7 (Cont.)

| | | | |
|---|---|---|---|
| GGGCAATTGGACCA | ACTGAGACCATGAC | AAACGCGTGCCCCT | TCTGCCGATAACAG |
| CCCGGAATATGCGG | GGAGAATGGATGCC | CGGCACATTACCAA | GAGCAATCTGCTGG |
| CAATGGGTAACAAA | CGCACGTACCTAAA | ATCGCGAATCCGCC | ACCTGTATCAAGGC |
| GAAATTGCCCGACA | GCCACGCTTAAAGG | GGCGAGTCCCCTAG | ACTTTGACCCCGAA |
| GGGATCCATGCAGA | GACATACAGCAGCT | GAATCGCATAACAA | TCGGCCAGATGGTG |
| TGCCGGAGACCAAT | AACCATGATCGAAC | AAGCTATAACCGAG | TCCTGATAAAGGGA |
| TCTGAAGAAAGAGA | AAGAGTCCGGGAAT | ACTCAAGGATACAA | ACGAGGCAGTCTTC |
| GACCCGTAGGGTCG | ACTCGAGCGGATCG | TCACCATCGGGACC | AACGATTGGCTAGA |
| CCACTTGGCAGACG | TTAAAAGGCACCGA | TCCTGACGCCGGAG | TAGCTGCCCATGAA |
| ATCTGACGCGGCCA | GGGATAAATCAGCC | CCCACCTGGCTAAC | TAGCAAATCTCCCG |
| AAGGATACGGCCGT | CTATCGAAAGAGAC | CCTACCCACAAACT | AGTAGCATTCGACG |
| ACGAAGGCCTGAGT | AACCACACTCATCC | ATAGCGAAGCATAA | AGCTGGTACAATAG |
| CCACTCCCGATACC | AATCGTCGGGAAAG | AGATCCCCATGCAA | TCGCATTAGCGGGC |
| ACGTCCCGTAACGG | AATAAGGGGGTGGC | TGGAACCGAAGATA | GAAGGATTTGAAGG |
| AAATCTGAGCGGAG | TAGAACAAGATACA | AGATAGGTAAAAGC | CCGCTCGGGTAGTG |
| CCGCGTTCCCCAGA | ACTCGCGAGTAAAA | CCCACATCGCCACT | TCTCCAACAATAAC |
| AGAGTGCTCCCGAA | GCGGGTCACCCTCG | CTACCCTACCGCGG | GGATGTGCGGTCCA |
| CGCAGCGTCAGTCG | GCATCTGCGCGGCA | CGGAAAACGGTATA | AAAGAGTACAACTT |
| CGCGACTCTCGGCC | GTTCACAGGAAAGC | AGAGCGGTGGTCCA | GCTTATACACGAGG |
| ACTGTCGACCGGGC | CCCGTACATAGAAA | GGACCTAGCATGGG | AGATCAACTAGAAT |
| GGGGGTAAGACAAT | CCCGCAACCTGTAA | CGATAGGAAACATG | CGTGCTTGCGCAAA |
| CAAAACCTATGCAC | GCGTTACCCGCCGC | CGTCACACGTGGGA | CTCAAGTGCCCCTA |
| AAAAAGTTGCGCCG | GTAGCACGATGCGG | ACACGAGCCGAATT | GTGCAACGCTTGGG |
| AACCGGCTAGGTAC | CGGATAAAGAGCAT | TACATCAGGAGACG | TCCCACAGCATTGA |
| GGCCGTACAAGATG | AAGTACGCCTCCAA | CGGAACCGACGTCT | GAATAGACGATTCA |
| CGCACCTCAGTCGC | GGAAACGACATTCA | GCAGGACTTCGGAC | ATGCCCAGCATTAG |
| AGTTCAGAGCGGGC | GGAGTGCTGGGCAA | TAGATAAGGAAAGA | CTAAGTCGGAATCG |
| GCAACTGACTGCCA | AACGGGGTGCGTCG | CATCGACAAACGAT | TCCAGTTAACCCGG |
| TAGGCGACACTAAG | GATAAGCCCTGGCA | CTCGTACGGCGGCC | ATAGGAGCGAATAT |
| CCTACTCGCCGAAG | GGGTGACTCACAGG | AAAAGTCAGCCTCA | TCGCCGTGCCTGGA |
| AGCGCAGATATACA | TGAGCTAGAAAAAA | ATCCAATAGGAATA | CACCGTCCGGTTGA |
| GGGGTAACGCTACC | CAGCCTGCCACATC | GAGGTGTAGTAACA | GTTCTCGACCAACG |
| CAGTCATACAGACA | TAATCAAACAAGCA | CGCTAAATCTGAAG | CTAATCCAACCGTC |
| GCTTCGCCACGCCA | CACGTGGGCAATGG | CTAAGCCGCTGAAT | AAATAACATGCACT |
| ACAGCGCGTCGGTG | GGCCTAGAGTCCAC | TCTCGTAAAGCGGA | GGATAGGGGTTAAA |
| GAGACAAATCCGTA | CCCTTCGGAGGGGG | ACGTCATGAGAATC | CACCTTGAGAATAC |
| GCCAGAACGGTTGG | AGCATAGAGATAGC | GATTAGAACCATGA | TGGACTAACTCGCA |
| CCCCACCTCGCTAC | CACAGAATATGGAC | TGAGTGAAGAGTAG | GCGAGTTGTGCGCA |
| TCAAGACTACGGCG | AAGTACCACCGTCG | CGCATTCAAAAAGT | GGCCATCGTGGGAT |
| GCGGAGTACCCTGC | TCAACTAAGAGGGC | TCAGAATACCTCGC | GCTGAGAATTGAGG |
| CCCATGTCGCAAGC | GGGGCAAGCATATG | CCAGGTAAGCATCT | GCAGATTTAAGACG |
| AGCCTCGGAAATCA | TGTAGCAAACCGCC | GTGCGGGTAGACGT | AGACATTCAAGTGG |
| GGCGAGATCGATAA | CCCAACGACATTAA | TGAACGCATGCTAG | TAACTTGACCAGCA |

FIG. 7 (Cont.)

| | | | |
|---|---|---|---|
| GCTTATAAACACCA | ATGGCGGATACCTG | CCTGTTAGGCGACA | AGAATATCCCTGGA |
| TGGCAGGTCCCCGT | CAAGATATCATCCG | AGACGCTATGAAAT | CCACAACCTACTCT |
| CGTGTAGCAATAAA | ATGCAGTGCGCTAC | GCCTGACAATCGGT | ATTCGCCCTAACAG |
| ATGAGACTAAGTAG | CAGCCGCTGATATG | CGTAAGCAAGATTA | GGATGCCACATCAT |
| GTTGAACCTGGGAA | CCCGTTCAGCATAG | AAGATGTCCAATAC | AGAGTAAATCACGT |
| ACGCGGATCATTCA | GACCAAGTTGGCTA | CCGTAGCTAAAAAT | ATAGTGTCAAGGGG |
| TAGGTCAGTGAGAA | CGCGGAACGCTTTC | ACCCCTGCAATACT | GACTTCGGAAGATC |
| TTTCCCCGGGCGGC | GGTTGGCCTGGCGG | AGCCAACCCCTATT | CATCTAACGCATGA |
| GACCGTTTGCGCAG | GCTATGATCGCCAA | GATGCTTAGGGACC | TAACTAGCACCAGT |
| TCGGGGACATCAGT | AGCGCTTTAGCACG | TACCAGTAGAAGTA | CTAAGCACCGCTTC |
| CATACCTTAGGACC | CTGCTCTGACGGAG | GGCAGCCGTTATAG | ACAGACTGATAGGT |
| GCACTCTGCAGTAC | TGGGGCATGCTCGG | GCTCGGCTTGCGGG | AAGTCAGCTCCTAA |
| GCCTAGCGTCGCTC | CTTGCCGGAACTCC | CGAGCCTCCTGCTG | GACTCCCACACATT |
| CTAACGGTGTAGCA | GCTGCACATCTCCC | TTGCCCACTGAGAC | GTACATGTACCGAA |
| CGCAAACGTTTCAA | CGAATTTGCCCCAC | GGCCTAATGACCCT | GGTCGGCTAGTACA |
| GCAGGCGTGATGAT | CGGATGTAACCTGC | GTAGTATCGGAAAC | TGATGCGGACGGAT |
| TAACAAACAATGGT | CACCAATCGTGAGT | AGTTACGCAGTCCA | AAACAAGTAACTCT |
| TTCCACAAGGTCGG | ACAAGATAGTTAAA | CATCAAGATAGGGT | AAATTTCCGACAGC |
| GAGCTCCCTACACT | TTCTGGGAAGCGGA | ATCCTAACCATAAA | GAATTGATAGGCCC |
| GTGCTACGAACGTC | CATGGAATAAACGT | GGCATAATACTCAC | CAACACAATGGATT |
| GTTCCCGCTACCAC | CTGTCAAGAACACT | TGGGCCTATCGGGC | CACTTGGAACGTAC |
| CCCCAATAGTCTCC | CAGATGGATCTACC | TAAGATGAAGCATG | GAGTTGACCTACCC |
| AGTAGGAAGATCGT | ACGAGATATGGTGC | CGTCAACCATTGAA | GGGCCACCTTATGC |
| GACGCCTTGCGCTA | TTACTGCGCACAAA | ACAGCATCGAGATT | TTGACCAAAATGGG |
| TCGATCCACGCAAT | GTCAATCTAAGAAA | GGTTAGCTGAAGAA | ACGGTGCGATAAAT |
| TGCTGCGAAGTCCG | GGGAGCGTGTGGAT | TAGTCCCAGTAAGA | CAGTGCATAGGGGT |
| TATCCATGACCAGA | TGACACATCTGCGG | ACGGGTGCCAATTG | GGCACGGTGCTCAT |
| GGAAGATTATCCCA | TTACCGCCACGTAG | GGCACATCGTTCAG | CAGTGAAGTCCCTG |
| TAACGGGCATTACA | AGTACATCCAGTCC | AGCAACCTACTATA | TTCCGGTGCAAAAG |
| CTGGGGAGCCTCTA | CTCAACGACGTCTC | GAGCCCATCTGTGG | GCGTCTGGACAACT |
| ACTAAATAGGGCTC | GAATCGCATGGGTC | GACAGTGTAGCTAC | CGGACCATCGGGTT |
| TTCCCGCAATCGAC | TGGACACGAGCCTT | CATACTGGCTGCGG | CATTTCAGCCGCAC |
| TGACCCCCTAGCGT | CCTACGTTGGCAAG | GTCGGCTGAGGAAT | CATCGCGCTGATGA |
| ATGTCCAGGCGCTA | GTCACCGATTGCGA | AATGCGATCTGAGC | GTGATGGCCACGGT |
| CCAGATCCCCCTTG | CGGGTCCTAACATC | GTCGCAGACAAGTT | GATACGCGTGCTCA |
| CGTGGACGGTTAGA | TTGTCCGCACCACC | ATTGGCCCCCCGCT | TCTGGTAGGCCCGC |
| TCCCTGGCTCGCAA | CCAGCCACTTCTGG | GCGTAGTTAACGCG | TCTAAGAAAATCGC |
| ATACACCGTATGAC | AGACATACCTGGTA | GGGTGCTAGGATAA | CGGACGGAGGTTCT |
| ACGATTACCACCTC | GCTAACCGTCGCAT | AACACTACTTAACG | GGCTCACCTCGTGG |
| AGTAATAGCATACA | TGTGGAAGCATGAG | TCCCACACCTCAGT | GATGTCATCAAAGG |
| GAAGGTCTGACTAC | CAGGCCTGTACCGT | TTCATCGAACAAAA | ATACGTCCAGAAGT |
| TGGCCAGGTGCTAA | TCTGTCCGAAGGAC | TCTAGCAGCGGCTC | CGCAGCTTAGCCTA |
| ATGTGGCGAATCCA | ACAACGTGCTGATG | CCTGCCCGTCATCC | ACGTAGGGTAGATA |

FIG. 7 (Cont.)

| | | | |
|---|---|---|---|
| GGCCTTCAGAGTCA | GTCACAGTTCAAAC | GAGTTGCCATCAAG | TGGGAACGTCAGGT |
| CCCACGCGTCAATT | CAGGGCGTTATAAC | TCAGCCCCTAGATG | GTGGGCGTGCAATC |
| CCATAGACGCGGTT | CCGGAATGCTCTAA | GTGTGCGGTACAAC | ACGCCACTTAGCTA |
| TTCACAAACACAAT | ACCTTCCAGACTAG | GGAGTGTGACATCA | GCCCTTGCAACGTA |
| AGCTATTCACCCAA | TCAAATCAACTACG | ATTGCGGCAATGCA | CTTACCACCTAGCC |
| TCGGGGTAAACATA | CAGTGGCTCTCGGC | CCCAGGTTTGAGCA | GTCTGCTAGCCAAC |
| CTGGGGCTGCTACG | TAGTGTCAAACACA | CTCCGACGATAAGT | CGGCGTCCCTGTAA |
| CGCTGATGTGGCAA | TGAGAAAATGCAGT | GATAGCAGTCTCAA | CGCCTGACTGCCAT |
| CGTCCCTGTCGCCC | TCAATCTAGAGGAA | CGCCTCCCGTGTAC | GGAGGGTCAAACTT |
| TTGAGAGTGACCCG | CGCCTGTGATCGCG | CAGCTACAGACATT | ACCGATTCTGGCCG |
| CAAGAATTACAAGT | ACTACTTAAAAGGA | TGATCTCGCGCCCG | ACTCGCACATTCGA |
| ATGACGGGTCGTCC | GCGATAATTCACAA | CAGCCTGGTCATAA | CCGCCTAGCTAAAT |
| TCTTGCAAACCCAA | ACGAAGGGTTACCT | TCCGATCGCCGCGT | TGTCTCCACACAAG |
| ATTGGAGTGGGCAG | GGGCAGAATAATGT | GCTAGCGGGTGCCT | GCGTGCTGCACTAG |
| ACGAGGTCGCTGGT | CCGGATCACTTAGG | TCAAAACGTTAAGG | CATTAACACACATG |
| GGCAGTACACCTAT | CTCCCAATGCTCCC | GCTGGCAGAATCTA | AGGCCCTTAATGCA |
| TCTCGGACGTAACC | GGGTTCAGGTCGAA | TCCTGGCGTCCGCA | CTGCACGCACTAAT |
| GCTGCTGTCCCCGG | CGTGCATACCGCAT | GTATAACCCAACCT | TCGAAATGCGGTAG |
| AGGTGGATACGCGT | CTCTCGCCACTAAC | GAAGTACCGGTATG | CCCAGACCTGCCTT |
| CGTCGTAGAGATAC | CCTTCGAGTGCCGC | CAAGCTACTGCATA | TGATATCGACAGGG |
| GTAACACGCCTCAT | GTTGGTGGACGACC | AGGCGGTCTGCCTG | TGTACAACGCACTC |
| CGAACTACGAACTT | CCCGTGGGTGACTA | ACACGGACGGTTAT | ATCATGATCAGCAA |
| TAAGCAAGTTCACG | GTAAACTGTCCCGC | CCAGTTAGCCGCTC | TGCTGACTCGGCGG |
| ACAGGTGCGCGTTA | ATGGAGGGGTTCAC | TAAAAATAGACCCT | ACACCTGGTCCATC |
| CACCTGCCTAAATA | ATGCGGCTCGGGGT | TCGTCAGACTACAA | TTAAGGCAAAAATC |
| CGCCAGCAGTGGTT | AGCGCGTACGCGTT | ACATCGGCTCGTGG | AATGTTACGCGGAC |
| GTGAGATACTCGGC | ACGAGCATGTGCTA | ACGCCGTTTGAAGC | TAAGATTACGGCAC |
| TGCCAGCTAAACTC | CCCGATTCATGAGC | CTCTGAGGAGCTCA | CAGAAAGATTATAC |
| CTGAACTCAGCTGC | CGACTTCGTCGGGC | GTCGGCGTCGTAGA | GGATTAGATAAGGC |
| ATTGTCCACGGAAG | CACCTATTAAAGGC | TAGCATTCCCAGAC | GCTTCGGGTCCGGG |
| ATCGTCGTAGGCGG | ACTGTGTGGCAGGA | GTAGTTCCCGGCCG | CGTACTGCTACAGG |
| CCTGGGCATCCGTA | TATGGAAATCACGC | TGCTGCACCCAATA | ATGGCCTGGAAATA |
| CGTCCAAGACCATT | CGATACCCCGTCGT | CAACCCCTTGACTC | TGACGGAATTAAAC |
| CGGGTCTTCCGCCA | GCGCGATGGAATTA | AGGTGTGGACTCAC | AGCCGTAGCTTAAA |
| GATGGTGAGAACTA | AGGGTTTAAAGGAA | ACGCCTCATAAGCT | AAGTCCGTCGCATC |
| CCATAACTAGGCTA | GGGTTGGTGCAAAA | GAGATCGATCCGAT | TGCCGAGTTCGAAC |
| TAGAAGGCTTCGAA | TAACACCCATGATG | CGGCTAGCGGGTGT | AGGCCTCAGATTGA |
| CACGAATGTGCACT | GCTAGGGCGATTAA | AGGCCCTACTTCGA | AAAGTCGATGGAGT |
| GTAAACTGATACAG | AGGACAAATGTTAG | GTGCATAACACAGT | GGCCTACTTAGAGA |
| TGTCACATAAGGCA | CTTGAGGAGTCCAG | TTACGATGACGGGC | GCATCTAATCAGGG |
| CCCGTAACCTTGGC | CTCAGATCAAACAT | TTAGGACTCCCGGA | AAGATTCATAGAGG |
| AAAAGTGGCATTCC | TCGGCACGGGAGTT | AACACATGACGTAT | ACTTCACGCCGCGT |
| GACTGGATCATCAA | GCGACCAAGTTCCT | GCCTGATCGATGCC | GCGAGGACTTTGCA |

FIG. 7 (Cont.)

| | | | |
|---|---|---|---|
| TACCGATGTCCCCC | TGCTCACATCGGCA | AGCCTGGATCGATG | CTTGCCCATGAGAG |
| GAGAGTATAAACTG | CATGGCTAACGCGT | CCGTTCAGCCAAGT | AGCCTCTGCGTCCA |
| ACAAGTGCGTCTAG | CTGCATAGATGCGC | CCAATGGTCACATC | CTTATAACCCGGGA |
| GTCCTGAGAGTCAA | TCCGAGTGAGGCTG | GTGGAGCCATTCGG | GACTGCTTGGAGAG |
| GAATCGCTGTGACG | TGTCGACAGCGTAC | TGCCAGGGGAGCTT | GGTTCCCAAATACC |
| ATTAGGGAAGTAAA | CCCCTACACCCCTT | GATCCGCAAATTAG | CCTGCAGTGACAGT |
| GCCTAGTCAATCAA | CTGTCTAAGGAGCA | GTCTACACACATGA | CCAATCGCGAATTA |
| ATGCGTACAGTGCA | CACCGTCATGTGAC | GGGCATATAATGGC | CGGCCATAATGTCA |
| AATAAGTGATGAAC | TTCCGCACTAGACC | ATCCGTAACGATAG | ACTAACCTGGGATA |
| TAACACTACTAAGA | CCAGATGTCGATCG | ACACATTTACCCGG | AATGCACTTCGGAA |
| GAGGACTGTAGATG | TTATGCAGCAGCAG | GTCCTGTCCCAAAC | GAGTGAGCCATGTG |
| ATACTAAATGCAGG | GTGGACAAACTCTC | GAGCCTGATGCGTC | CTCACCGTATCCAC |
| CGACTTAAAAACTC | GCCACCTCAATGTA | AATGTTCGCAGGGC | AAACGCTCATGTGA |
| TTAACCCAGGTAAC | CTTCGAGACGTGCG | TCGCTTCCGGGAAA | AGCTAATAAGCGTG |
| CCGCTAATAATAGC | GACTAACCGATAGT | GTTAGGGAGGCGGT | TGAAAAGGGTGTGA |
| CCGGCAATGGGTGT | GAGTCAAAACTTCC | AGGTGCTCGATGGC | AAGATTAACCTGAG |
| CGTTAAAGTAAACG | CGTAAGTGCCGAAT | CGGCTATCACTACA | GGCAACTTCATACC |
| GCCTAAGCTACGAT | GTAAGCTCTAAACG | CGCTCGAGCGTATC | GCTGCACGTACACT |
| ACAGCGGCTATATC | CGAAAATGGTATAG | ACCTCACATACATC | TCGTGGGATCACCC |
| TGATAACAGTCGAC | GGGATTGCTAGCGC | GGGACCGTCCGTTA | GAACGGATCGTGTG |
| AGGGCTCTCTCCAG | ACTCAAGAATCAGT | GGGTGCGCCTCAGT | GACCTCATTGACCG |
| CAGGGAGGAGTCTT | CGCCGAAAGTGTAT | GGGTCCAATCCTAG | GAGCGTGTGACGTG |
| GCGATGTCCGACTG | CGCGTTACTACAAG | GTGATCGTACGGGA | CCAGAGAATATGGT |
| GAGCCTCCTCTAAA | TATGGTAAGGGCCG | CAAGCAGGTATCCT | GTCAAGATGCAGAT |
| ATGAGTAAGCTAAC | TCTGACTGCGCCGA | TCCCCTCCCTAAGC | TCTCGTGGGACAAG |
| CACAAGGCAATCTT | CCAGTGCTATGAAG | TCCAGAGACTTGCG | AGTTTGCGACAGAA |
| TCAATCCCCCACTA | ACCTACAAGCATTC | TCGGTGGATGCCAA | AGCAAGCTGGGCTT |
| CGAATTCTCGGACG | GGATTATAACCGCA | GCTAGCTCGGTAAC | AATTAGGGTAACCG |
| GGACTCCTTGGGCG | TCCTAAAGAGCTGG | CAGAGGCTTGACTG | TTTGGACGGAGGCG |
| CAAATTAGGCCTAG | GCTAAATGAATCAG | AAGGTGGCCTTACG | CCTTGAGACAGTAG |
| CCATCAGTCTGCGA | CTAAACCTCCCCAT | TCAGGTACCTGCGG | ACACTAGTTGGAGA |
| CCATTTGGGAAAGC | ATGATGACGTAACA | AATACTAAGTGAGA | TCGCGTCTAAACGG |
| GGAGTAAAGCTGTA | TCGGCGAAGTCTAG | TAGGAGTAGCCACT | CTCGAGCTATACCG |
| CCTCCCGAAATTGC | GCACCTCTTCCGCG | GATCCCTGGAACAT | GGAGGATAATTAAG |
| TGAGAGGACCTGTA | TACAATGGCGGTAC | ATGCTATGCCCACA | AAGGTTCCTGCCAG |
| ATACGCTGCCGCTC | CGTACTCTGCACAG | CAACAGCGATTGCT | AAACTATGCATAGG |
| TCACCCGATTCACA | AGGATCCGATCTCA | GCAGTTAGGATCAA | TCGCCCATAAAGGT |
| AGCTAGCCTGGGTA | CCCGTCCCTACCTC | GTCATGGCCCTGCC | AGTGGCTGGTACCG |
| AATAGCGATCCATG | CGGTATCTAAGCGA | TAGAATGGGTCAAC | TGGCGTAAGAGATA |
| ATCCCGCATGAATG | CACGTTCCACACTC | GGGCGATTCGGTAC | CTTAGCACATCCCG |
| GTCAATGCTCGGAC | CGGATTCCCCACTG | CAGACTACTAGCTC | CAAATGCCGGTTAG |
| CGATACGTGTCCAA | CCCCTCAACCTGTA | CCGTCAATAGTCCG | CCACCTGACTCTGG |
| CAGTATGTGGGGGC | CAAGGTACATGGTC | GCCAAGCCGTAATT | CTGCTTAACCGGCA |

FIG. 7 (Cont.)

| | | | |
|---|---|---|---|
| ACATTGGCGAAGTC | ACGCATAGTCTGAA | ACACCAATTACCAT | TGGGTGGTAGACGC |
| TAAAGATCCTACGA | TCGTTGAAAAACAA | GCCTCGGTCCATAA | TCCGCTTAGACGCC |
| CTATTAAGACCGAA | GCGAGGAGTTAAGT | AGGAACCCATCATT | GCGATTCGCCTCAC |
| ACGTCCATCGATGG | CGAAGTGATCGGTA | GGCGTCCCGATTAG | CGGCCTACTTCACC |
| TCAATAATCGAAGG | TCTGCGCAGCCGCT | TTCAATCACACGAG | ATCGGTCACTCACA |
| GTCCATATCGCCCG | GAGCACTGATCAGT | CACCCCTTACCTAG | CCACACTTGGTAGA |
| GACTTCACATGGGC | GCACGTGGAGTGGT | TACGGTCCACTGAG | TCCAGACTGACATA |
| CACGGGTGTTCGAA | GACCTCTAGCCACT | AGCCGACACTACTT | CGGAGCAGTTCTCC |
| AAGTTCTCGGCAAC | TCGATTGCCAGCAA | CGGCTAAGTGTACG | ACGTACGTCTCGGC |
| GCGGTAGTATACCC | CCTTAAAAAGTACA | GATGTGCGCTCGCG | GATGATGGGTCGAA |
| GTAAGTGACAAATA | GTCAAGGAGTTACG | GACCTCTTAAACAA | CACCCGTACAGATT |
| CATTAGAGGTCCGG | AAATGGCATCTCCC | GCCCTATACGTGCA | AGATAGTCTGCGGC |
| CACTGCCATTCGCA | CAGGTTGCAGTAGC | GCCCTTATAAGGAG | TTCACCCAATGAGC |
| GCACCGTCCTAATC | CGAATTACACCTCA | CCTCAAAATGTGAC | GCACCGAATATTAC |
| CCTGTGCCACGGGT | GCTGCAGGGCTGTA | GAGAATTCCTGGGG | GGAACCCCGTTCTA |
| AAGAGCGCTGCTTA | CGCCCTCTCAAATA | GCCATTACTGGGCG | CACTAGGACGGTTG |
| GTGGGCATACCGAT | CCGTTAGGATCACC | GGTCCCTAGGCGCT | CAGCCCCAATTTGA |
| CTTTCCCACCACGC | TCCGGGATGATCGA | AATGACTATCGCCG | TTAATGACCCAAGA |
| ATTCGTGAAAAAAG | ACGTATAGGTGAGC | AGTACCGGGTTAGC | ACCCACATTCAATG |
| AAGACTTGGCCTGC | TCCACCAGGTCGAT | CCGTCCAGATTAAA | GGCGAATAGGCTAT |
| ATGTGCACGCAACT | CCAACCCTTTAGAA | TGCGCCATCTAGAA | CAAGTCCCACTTGA |
| AATAATGCTCACCA | ATAGTAGGACTGAC | TCCAGCGCTGGAAT | CGATCGGTTGCGCC |
| GCACAGTTAGGCCT | AGCGCATCTCCAGT | CGTGACGTAGGCGT | GTGTAACAGTGCCA |
| AAAATCTACATGCG | CTTACAAAGACTAA | GTATATCAGCCAGA | TCGCGCAACTTGGC |
| AAGAAATGGTGTCC | GATGCACCTGCCTC | GGTAGGCAGTGACT | TAGGTCCCGTCCAC |
| ACACGCCAGCGTTT | AGGGAGCCCTTGCT | GTCCTTAAGCCGCC | TTCCGTGGAGGGAC |
| CTGAAATTCGCGCA | TAGATGCATCCCGA | CATGGGCGATGCTG | GCTTGCCAGGAGCT |
| CGATCAGATCCAGT | AGCGTGTTCACGCG | GGTCCAAATGCATG | AATCCTATCGCGCG |
| AGGTGAAATCGTCC | AGTTCGACCGGCTC | TAACGACCTTCGAA | GGGTCCTAATCCCA |
| TAGAAAGGAGAATT | CCAAGCGCTTTGAG | TCGGTAAGCTACGC | TCTACAGGGTAAAG |
| AGCCCGTTGGATAC | AGGACGGCTTGATC | GGAATTCCATCGGC | AATGCCCAGTGCTA |
| CCGTCTACCTGCCC | TCACTAAGAAATAA | ATCAGTGTGGAGGA | AGCCCTTGACCGGT |
| CAAGAGTTTCCGGG | CGCTGGATGACGTG | GGCGGTGCCATTAC | AGTGGTCACATACC |
| GATCGCTGAAGTCG | TACGAGCTGCCTAG | GCCTTCAAACTAGA | CTGAGGAAATCGTA |
| GCGGTCAAGGGTTA | CGCTCCGGTATGGG | CCTTGCGTGCAGGC | CCCGCTCGGTAGTC |
| ACACTTTGGAGGGG | CTCGCCTATAGCCC | CGTTACTGGCCACG | CACGCGAACTCTGT |
| TAGCATAGAACGCT | GGAGGCTCTCTCCG | GTGTACAAGTAGCC | CCAACTGAGATGTA |
| GACCGTAGTAAGCT | AAAGTGCAAATTAC | TTCGGCTGGGCCGG | GGCGAGTGCGTAGT |
| TACGGGGTTAGAGG | TAAAGACTAGGTGA | ACGCGAGTCATCTG | AGAGATAATTGACG |
| GCACCTAGGCGGTT | GACAACCAATTCTA | GTACACGTGGCTAG | GCCATCCTAGTACA |
| AAACCGTACCGTTA | GCAGCCTGAGGCTT | TACCCTGATGAGAA | CCGGCTATTCGCCG |
| CGGGGTGTACCTAC | GGTAGAAAATATGC | CCTGGCCTGGAGTA | CAGGTGGGGTCCCT |
| GGCGCATTTCCGAA | ATCTACGAGATCGC | AGCGAGGATCACTT | TACAACTAACCTCA |

FIG. 7 (Cont.)

| | | | |
|---|---|---|---|
| GGGGTGGGCAATCT | GATTTCGCACACCA | TCTGCCGTCGGCAC | TGGGAGATTGGGCG |
| TCGCGGTCTACGAC | ATGTTGAAGGGCCA | CTAGAGATAATAAA | TACCAATAACGAAT |
| TCCCAACTATAACG | TTACAGCGCGAAGT | CCGTGCGATGTGCC | GATGGAAGGCTGCT |
| TGTCACACGCCATC | TATGAGCCTACCAA | AGATCGCCATTACG | GAACCTCTCGAAAT |
| AGTGCTCAAGAGGT | TCAGGTGGCTCGAA | TGTCAGCGGGTCAG | ATGTGAACAACCTG |
| TCCCGGAGTAGATG | ACCTAATACGGCGT | GCTTCCAGCAATAC | CCCGGATTCAGGTG |
| AGCTCCCGTAGGTC | GGCCAGAAATCTTG | GCTTAAGAGGCTAG | AAACCCCAGGTTCT |
| CCTGCCTCGCTAGG | GTCGTATGCGCGAA | CTTTGCGCCGCGGA | CGGCCTGACTACTC |
| TTTCCCAAGCGCCA | CAGCTAGGTGTGGC | TAGAAGTGACACTA | GGCTTCGGGGTCAC |
| TCCACAGTGCGTCG | GACCTGGGCCTATG | TCGAGTACGGTGGC | AACGATTCCGAATC |
| ACGGCTGGTTGGAG | AAAGGATAGTCTGC | GGTACATCCGCTAG | TGGTACGATAGAAC |
| GCTCCAAGATCTGG | TGAGGCAGGTCGTA | GCGCTAAAGTCCGT | GAATCCTAGATCCG |
| ACCGAATGACAATT | CCCGTTTGCACGGC | CGTCTCCATCGGAG | AGAACCATTTAGGG |
| TAGAGCAAACAGTT | GCTACCAAGTGATC | CCCTACCAATGAGT | GTACGATAACCTAA |
| GGGGTCGTCGTGAA | AGTGCTGTAAGCCG | CCACCGCTCTGCAT | GCGTAAATGCAATG |
| GGGGGACCAGATTT | GCGACTGATCTGCC | CCTCACCAGGCTCT | TAGCTAAATACAAA |
| TCAGTCACAGTGCA | CCGCGTTACTCGAC | GTATTCACGAAACA | CCGCGTTACCTCCG |
| CCTTCCGTAGCCGG | GGGTGGAGTATGAA | TTGCTAAAGAGCCC | CCGGTACAGTGTCA |
| CGTACTCCCACTCA | TCCAAACGCATTCC | GCGACCGTACTGAT | TTCAAACGACAAAT |
| GTAGGCTGAACGTA | CCCTCAAGCCTCTG | CGCTCGCTAGGATA | TGCGGTTGACAGGA |
| GCCTAGACCTTACG | CTTCGCCTAAGCCC | GACCATGTTGCAAG | ACTCCCTAAAAAAT |
| AACAATCATCCTAG | ATCCTAGCGGGCTG | CCGTCTGCGCCAGT | CCGGTGAGCTCTCG |
| TATCTACCCGGCGG | AGACGGCTTGAATC | CATCCCGATTACAC | TCGAGATCCAATGC |
| GGGGAGCCTCTTAC | TCCGTAGCGTCCGG | GATGAAAGAGGTGT | AACGCGTGTCGGGT |
| AAAGAACCGACTTT | CGAACCCGTCCTAT | GGTACTAATCCCGA | CCGACCTTGATCGC |
| TAGAGTCTGGAAGA | CTAGTTCGACCCGG | AACGTTCCTAAGGA | GGCTGCTATACGCC |
| GTTAGACTAGAGCC | ATCCATTGCACGAA | AACGGGTGGAGTAT | AGACCTCGAATGCT |
| ATCGTCCAGCGCCT | ACAGTCATAACTAA | GGAGTATGCGCTGG | ATGGAGACAGGTGT |
| CGGGCATCATCATC | CTTAGCTGCGACGG | ATCCTTCCGAACGG | CCTTGACGTGCGAA |
| ATATGGAAGAATGC | TAATTAACCCAGGG | CCCTCGCTCACGTA | CGCCGTCTTCCGGG |
| CTGTGAGGGTGGAC | CACGATACAGTGCT | ATACTTAAGGGCAC | CGATACACGTATCA |
| TGGAGTTACAGGGC | ACTGCTGGAATCAA | TCGTACCAAATGAG | CAGGAACTTGAGAT |
| GGCCAGGTTCCACT | TGTAGGGCCTGGGA | CCCCAAAGGAATTT | GAGGTTAGCGTGCG |
| AGGAGATGTCCATA | CGGTCACCTACGTA | GATCCGTTAAGGAA | CAGTACGGCTACCT |
| GCTCGTGATGAAAC | AAAGCGCTCTATCG | TAGGCGACCCCGTT | AACCAGGCTCTCTG |
| GCACGCGATTGTAG | CTATGAGAAGTCCC | TTTACGCACGGACG | AAGTCAAACATAGT |
| ACACCAACACATTT | AACCACCAGCTTTG | TGGTTGCAGACAAC | GCAGACTTTCAGCA |
| GCGAGCCTCCCTTC | AGTCTACAGCCATA | AAGAGGTATCGTAA | GTAGCTCAGAATGA |
| GTTCGTCACCCCGC | CAAATAACTCTACA | ACCCGTGGGAAGTT | GAATAACTATCGCC |
| ATACCCCGTACATG | CAATGCCCACTGAT | CACACGCCCTTGTG | TCAAGTAGGCCGCT |
| CGTCCCTCGTCGAG | AGCTCCATCCCCGT | ACACAACTGGGTTG | AGGCATGGTCGACT |
| ATAAAACACCCTTC | TAGCAGATAGAGTC | ACCAAATCAATTGA | CAACGTGTAGCATC |
| CATTTGCCGCAACA | CCAGTTTAGAGCCA | CGTGCCTACGAGTA | CGTGGGTACTCACC |

FIG. 7 (Cont.)

| | | | |
|---|---|---|---|
| CAACTTTAACAAAC | TGTCTAACCGCCAA | TACCACCCCAAATT | ATCTTGCAGGGAAC |
| CGGTGCTGCCATGC | GCTAGAAATATGGC | ATGGTCCCAGTGAC | CGGAATCATGCTAC |
| ATGCGCATTCGGAG | CTCGAAACCATTAC | GAATCCTGGTCCAC | ATTCGACAATCGCC |
| CACGAATACATTGA | ACTGGATGGATCGC | TGCAGGTCATCGAG | GATTTCGCAGCAGG |
| AACGTCACTCAGTG | CAGATAGTCAAACT | TAGATATCGCCGGC | TTGGCAGGCGGATG |
| AAATTGCAACGGTG | ATGAGGAATTGCAG | CAGCCGTCGCTAAT | ATGTCCCACGATCC |
| GACGACGAACTTCT | GCTATGGCTCACAC | TTGCGGGAGAATGG | TCGAACGATCCCTC |
| ACGTGCCTGTGAAC | GGAAATGTCATCAA | ACGCGTAGTCACGT | GCGGACACACTTAT |
| TCCGCAGCTGCGCT | CGCATTCGAGCGTC | CGCGACTCACTCAT | ACTATTGGCGCGGG |
| AGAGGTTATACGCA | CCCGTGGTGCTCAC | CTACGTAGGTGACA | GGATCCACATATGG |
| AACAAAAATAGCTT | AAAGTACTCCCACT | CTCGCATCGCGGTA | CAGTTGGCACTAAA |
| TGGGAGATAGTCAA | ATTAACTGGAGAAA | CGCTTACACAACTC | TCGCCTGCGCTAAG |
| ATGCGCGATTCACC | AACTCACACATTCA | TAGCGGAGGCTACT | TCGCCGAGCGTTAC |
| GTATAGGGCTCCCG | GCACTTAACGGGCT | AGATTGGACCCTCA | TTGAACAAAACATC |
| GACCAGGCGTATTG | AGGGTGCTAGGGTA | GCCATACCATACTC | CCGTCGGCTTACGA |
| ACCAACCTCGCGTT | ACCGCTGTCGTAGC | GTCCGGCACTATGA | GTTCAAACATAAGG |
| AACAAGTAGTGCTA | TCATATACAAGGCG | CTAAGGTTCAAGGA | ACTGCAACCTGGCT |
| TGTAACAACACTAA | GAAAAGACTCCCTT | TACGAGACGTCATG | GCGGTCGGCCTTGA |
| TGAGTCGAGGCATA | CAGATGTACGGTGA | GTATCAGTCAAACG | AAACACTAGGTGTC |
| CCGACAAGCTTGGT | TGAGTGGACACCGT | GTAGCATGAGTACA | GCGGTTAGTCAAGC |
| CGTTAAGCCGGTGG | TAAAACAGGGGTCT | GGAACGATCTCCCT | TGCGAACATTAAAA |
| CTCCCACAAGCATT | AGACCGTTATCCGC | CGCGGATTCGCGGT | TAAAGAAGATGTCC |
| GGGTTAAGAGGTGC | AGCTATCAAAATAA | CACGTCAAATTCAC | GGTGGCGAATGCTA |
| GAGCCCGTTTCCCG | TTGCGCCACACCTC | CACATACTCAGATC | CACGTCTGGGTCCC |
| ACCGACGTAATGGT | GATAAACGGCGTTC | ACCCTTGAACTGAC | GACGCGCTTGAATA |
| AGGCAATTGACCGT | GTAGTGGGCCAAGT | AAAATGCGCGTGGT | AGTCGGCTCTCCGG |
| ATCTACCCCTGAGG | TGGCACTAACACCT | GTTAAGACGTCCGA | GAGCTTACTAAAGA |
| GTTGAACTGCGAGA | GTCAAAACGCTGTC | CGATGTCGCTACGC | ATGGCTAGTGCGCG |
| GGATCGTCATGAGC | GGGTTACGCACCAT | GATGACGGAATTGA | ACTACAGGCGCATT |
| TGAAACCATGGGAT | TACTGGAGGAGTGA | CGCTCAGTTAACCC | TACGAGGTACTGCA |
| AGACCGCGTCGTGT | GACGAACGAGTTTG | GCCGCTGATGAACT | TGTGCCGAATCGAG |
| TAGCGAGCTGCCGT | AGCCGAATTGGTAA | TCATAAGACCGTCC | GTACCGATGGGCTG |
| ATAAGGTACACGTC | CCGAGCCACTTCTC | GTGACGCAGAGTTC | GTCCAGTACTCCCA |
| GCGGCACCACTATT | GTGCCACCTAGGCT | GGTGAGCACTCCGT | AGGCGACTACAGTT |
| TTGGTGGGGAGAAC | TGATAGTGAGGAGG | AATAAGGTACTCAG | ATCAGGGTGCGCTC |
| GCTCTCTAAAGGGA | GTACTGCCGGTGCA | GTGATGTAGCGCAA | GGAAATTGAAGCGT |
| CTGTACGTAAAAGG | GAGATTTAGCAAGC | GCTGGCTTCAAGGA | GAGATAAGGCTAAT |
| AGCTCCCGAATCGT | TAACCACGTAAACT | CAAATAAGTCAGGT | TTTAGAGCCGACCG |
| AATGTACCCGAGTC | GGTCCCCGATGCGT | AAAGGGGACCTTCT | GTTCGCGACCGGGT |
| GCTTCGTCGCCCAG | GTGAGGAGATTACC | CGACCTTAGGTACC | CATCGTGGAAGAGT |
| GTAGAAGACTGGTG | GCTTTAGGGACAAA | CCCGGTAGCGATTG | AAGTAGTTGCCGCA |
| CCACATGAGATTCC | CTCAAAGGTAAGGT | GTGACTGGGCGGAT | ATGGCTGCATAAGC |
| CATCTTGCGCCCAC | GGGACTAGTGGGTC | CTCCGCATACGCAT | GATGGGGCTATACA |

FIG. 7 (Cont.)

| | | | |
|---|---|---|---|
| GCCATAATCTGCGC | GAGGCTCGTAAGAT | AAGGCTAAATCTAA | AGGATCTTCGGCAC |
| CGGCCTCGATGGTA | TGGGCTGCGGGAGT | CTCAGCTCGCTAGA | CTACCTCCGCTCAG |
| GGTCGTGCGTGGAC | CCTGTACGACCTAC | CTGTGCTACCGAAA | CGATGATTGACGCA |
| GACTGCCTCGTAAC | CCTCGGACATGGTG | CACCAGTATCGTAG | AACTAAACTCGACT |
| CGCCTATAAACCTG | CTTACTGAAACGAG | TTGGCAGGTACGGG | GACTCGTCCCTCAC |
| TGACCCTGATCGAC | GCTGGGACTAGTAC | TATACATACCGGGG | GGTCACAGAGAATT |
| ACTCTCGCCGAGTG | CTCCATCACTCCGG | GAGATGGTGGGAGT | CGGGATACACTGTG |
| CGGTTTCAACCGGG | GTGGGAGTATAAGG | TCCTTCAGGAAAAC | TCGCCAACGTATCA |
| TTGAACGAGAAGGT | AAAGCGTAGGTCAT | CAGACGTCGTTGGA | TTAGGCCGAACTGC |
| GACGGCTATACAAT | TAAAGTGGGACCAT | GATACTATGACGAC | TCACAAGGTAGGCT |
| TTGCTGGCGCCGAG | CGACTCTAGGGGAT | CGCTGCTCTCCGAG | TACCGGCAACTTAA |
| ACACTGGCTTGACC | ACGGCTCTATGACC | CAATGGAAAGAATT | ACAGCTTAATCAGG |
| ACTGCACTCACTAA | TTCGCCTCCCCGGC | ACATGAAATCTCAG | AGTCTAAAGTAAAC |
| AATGCTAGGTAGGG | ACTCCTAGCGATAA | TCCCTGCCCACGCT | CCCCGTGCCCTTCC |
| AATAACGATTGGAG | CTGTCGACCCCTAC | CGGATACCTACTGG | TTAGAAACGCCATA |
| CGCATGTGAGGCGT | CCATGGATCGAGCT | GCACTAGGTATCGC | GCACATACATAAAT |
| GCCGAGGTCGCTCT | GGCGTGCTCAAAAT | CACAGATACTAATA | TATCCGCGTGCAGG |
| ACTCCAGTTCCAGG | CGGCATGATCCCTG | ATTCCTCAGCAGGC | CCGCGTCCGTACTG |
| CATCATGGGCTGAG | TGAATAGCGGTAAG | TATTCGGCGAGAAC | TGAGAATCCTAAGG |
| GATAGACATTAACC | CATTGAGGCAAGGT | TCACCACGCAATTG | TCGACATATCCAGC |
| TGGTGGACTCCACA | ACATTCGAGCGGTA | AGGGGCTTCTAGCA | GTTCTCCGGAGGCC |
| CAGCACCAATCCTT | ATAGCAGGATAACT | GAGGATATGGCTAA | GGACGGATACGGTT |
| GACTTAAGCGTGGC | GACAGACACCTTTG | GTCAGGCGTCATGC | AGATCACACAGTTG |
| ACCTACGAAGGGTT | ATTGCAGTAAAAAA | TGCCGGTCCCTGCG | GGGGGTTTCGGAGG |
| ACCTATAGTGAGAG | CGCATCTTGAGCCC | CCGCTGCATTCAGC | CACAGCTAATTAGG |
| CTCTGCGAGTCCCG | CTATGCAGCTACCA | AAAAGCTTGTAGCG | CGAATGACCGTGTG |
| TCAAGACATTGGGA | GTAGTGCTCAGCGC | GATGGGCTGGTAAG | TACCTGTCAGGAGG |
| ACCCTGGCCGTATC | AAACGAGGTATGTG | CACAGGCAAATTCT | TGACCGTCAGACGT |
| GTGAGTCAGTCCCG | AAAGAGGGGTGTTG | TTGACAATACAACC | GCGGAATTCATGAA |
| AAGACCCGTAGCTT | ACCTTTGCGGGGGC | GCGGATTGGTGAAA | CTGGACCCCTCTAC |
| GAGATTGCGTCCAA | ATTGCACGACATGA | ATGTGCCCGTCGGA | ATGGGGACCGCATT |
| CGAGGTTGTGAGGG | CTTGGCCATCGAGG | GACCTTTGGACAAA | TAACTCGTCGAGGG |
| AGGTAACCACTTCA | ACCTTAACTACCAG | AACGATCCATCTCG | CCTGGGGAGTATGC |
| GGTAGTCATAGCCC | CCTGAATTCCAGAC | CAGGCGATTGCAAT | AGGTCCTCGCCTCG |
| GGGGCTAGATTAGC | GTATGACATAAAAC | CGAGTCATCGATGG | GTTACGCGACAGTA |
| TGCAGATTGCCGGG | GATAGTAACCCGTC | TGGAGGCACTGGAT | TAGGCAGGTCTCAC |
| ACAATGTTGCGAGA | ACCCTGAGCTTCCG | ATCAAAGTAGTCCA | TTCAAGACGTCGCC |
| ACTAGACATACAAT | CACGAATGATTCGG | TTGAAGTGAAGGCC | GGAATCGAAGTGTA |
| GACTCTAGATAGAG | CACTTCCTCCCGGG | GTGCTACATCGAAC | ACAGCGTCGCCTAT |
| GACAAATGAAAGTT | AGACCTGGGTGGTC | GCGGTAGCCCCTTG | GCTAGGAATACTCG |
| CAAAGAGTGATAAT | TAAACTCGGGCTCC | GTTCTGAAACCGGA | GGCATAGGGGCCTT |
| CATCGTATCGGCAA | CATCGCGAGCTTCC | TTAAGGAACATCAA | AGCTTTAACGAGCG |
| CCGCCACTCTGTGC | CAGAATGGACCCTT | CACCTGCCAGTACT | CGGTCGCATACACT |

FIG. 7 (Cont.)

| | | | |
|---|---|---|---|
| GGCGACGTCCAATT | CAGAATAGCTTCAA | GGCCTGGGACTTAC | AGTGCTTGGAAGAC |
| CGAGGCCTCCATAT | TTCGACCGCGTAAG | GTAAGACCGTGGAT | GTAATGATAGAGGG |
| CCCTGTACGTCCAA | AGGTGAGCGTGATG | AGGAGACAGGTTGT | GTCACGCCTATGAC |
| CGTACCTAAACGTC | AAGCCATGCCCGTT | CAGAGTGCTCATCC | GAAGCCTGTTCGGG |
| GGTGAGCGCACTTG | TACCTCGTGCCCGA | AGACTCCGTACCCT | CTGCGCTCGTGGCG |
| CTTATGCGCCAGAG | ACAGCTAAATAGTC | AGATTGCCCCAATC | AGATGTCCTGCGCG |
| ATCGAACGCTATAA | GGATCGAATATCGG | GGAACGGACTGGTT | AAACCAACCTTACT |
| CGGTGATAGTCGAG | AGTTACTGGGACGA | CCCAGCTACTGACT | AGCGATGTATCCGA |
| TCCCCACTGGGTAC | ATCATCAGAGTAGA | TTCTCCCACGAGGA | AGAGCTCCCGTCTC |
| TGAATCACTAGACA | GGAAAAATCAGTGT | CCTCAGAGGTTAAC | AATTGCCTACCCCC |
| AAACGTCGCTCTAA | GGTCCCAGCCTCAT | ACTTCATGCGCCAA | AATGCAAGGTCTCA |
| TAGAGAGTCATCGA | AACTGTTAACGACC | TCGACTAGCAACGT | TAATCAGGCTACCG |
| AGTGGTCGTGCCAA | TGAAAAGTCGACGT | GTTAGAAGATAGAG | GGAGAAAGTTTCGC |
| ATACCGGGTGTGGG | CAAACTTGAATCCA | CTGACTGCCAGAGT | CAGGGTTGATGCAA |
| CCAGTAGCCCATGT | GCTTCGCCAGTAGG | TTACTAGGGCGACC | TATAAGCAAACAAT |
| GTCCCGGAAATTGA | GTGGCCTCGCCTAA | GTGCCATCCGCCTG | GGCAGGTTACAGTA |
| AAGTGGAGGCTGTA | AAGTGTCCGCGTGA | CATAACCTCGATAG | GGGAGGTGACCTCT |
| GTAGAGTAGATAGC | TCACCGCCAATAGT | TCTAAAAACGCTCG | CGGTGAACTTACCG |
| GTCAGCTGCGCCCT | ATTACGACGCATGG | ACCTTAAGCCGGCT | ATCGATCTCAGACG |
| ACGTTCTAACGCAG | GCCACACTAATGGT | ACCGCGTAGACTTA | CACCCTGCCCTAGT |
| CGGACCCCACTTTC | AATCTCGGTGCCGG | ATAGAGTTAGACGG | AACGTCTACCGGTA |
| GGCTTGAGATGAAG | AAATATGCAGGTCG | TTCGCCAGACTACG | CGTTAAGCCAAGTC |
| CGTTACTACGACCC | ATGAAATAGATGGG | ACCGTACTTCGGCG | CGATGCATCTCAGG |
| TGCGTGGCAGGACT | TGCCGAGACCATTC | TATACCCAACTCAC | GTAGCGGAGCTCCT |
| TCATGGCTCAGCAA | CAATTCAGAAGTAA | TATCACCATACCCC | TCCAACCGAAGTAT |
| GCCGTCAACCTCAT | GACGTTCTGAGGCG | TGGGCCTAGCAATG | GACGTTATGGCGGC |
| TCTCCGTAAGGCAG | AATAGCCTTAGGCC | CAATAGTGCGCGCT | GCGGTCTAGCGGCT |
| CCGTGCCGCAACTT | GCGCACATAGGTGT | AACTACTGGGATCC | CGGCAGTGTCGTCA |
| GTTACATGCACGGA | GCCCTGATTGGGGA | AATTAGGGACGGGT | TAATAACCGGAGTG |
| GACGAGTAGATGAT | AGTTCCGTGGCCAC | GGATTCAGAGCGTC | TGTCCGGGTCCAAC |
| TAGGTAAAGCCGAT | AAACCAGTTTCCGA | GTGGCTCGAAAATC | CTCAAATCGCCTGG |
| AATATGGCTACGGG | AGTCGCGTTACACA | CACTCACGACTGGT | TACGACTAACAATC |
| GTGGCGTCGGTCGA | CGTCGGGAGGTGTC | CTTATGGGCAGGCA | GTAGCTGGGAGGTG |
| GCATGACTCAGGCT | TGATAAACCCTGCA | CGACTTACGGCACT | CCCGTTGTCAAACC |
| CGTGACCAGACTTC | ACTGCAAGCTTAGG | CTACACACGATTGC | CCGGACGATCTTCG |
| AACTACTCAAACTG | CAAATAGCATATAA | ATCGTACACACAGT | GAGCTACTTGCGAG |
| TAGGGACGATGAGT | CTGGCCGTACCTGA | AGGTAAGGGCAGTT | GTATCGAATCCCAC |
| TGGATAATAGCAAA | GATATTGACGGGAC | TCGCGAGCCTGGGT | TCGTGGACGCGTGC |
| TGGATCTCAAGAAG | GATATCAAAAGTGC | AGCCGTCCGACCTT | TAAACCTACACATC |
| GGGTATCAGTAGGG | CCCTAATTCGCCCG | AGACCGGTATGGAT | CGATGATGAAGGGT |
| TCACCTCGCATGAA | GGATATGGAAAATA | AGTAAACAACTCTC | ATAATGCTAGGAAA |
| CATGGGACGGGTAT | AGCGCCTACCTACT | CAAACGCCTTCATC | TAGGATCCGTACGG |
| AGAGTTGAGCTCCC | TTGAAGCATGGGGA | CGACCCAGTCACTT | TGCCGCTGACCTGG |

FIG. 7 (Cont.)

| | | | |
|---|---|---|---|
| CACCAAATTCAGCT | CTAACAGTTACAAA | CACCAGATACTGTG | TACCCGTGGCGTGC |
| TGATCCCCACTCCC | ACTACACTAAAATG | CTTGACGCTCGGAG | CACAGTTACCCGCT |
| ATATCCATCAGAGG | GTGGACAGTCCTGA | TAAGCGGGATGTAA | TGTCTAGAGAGCAG |
| CAATCCAGTCCTCA | TTAGTCAGACCGCC | CAGCTAGGTTAAAG | AGATTCACAGTCGG |
| AGTGTACGCCGGTG | CAGAATTAGACATA | CAAAACGATTTGCC | GATGAACTCCAATG |
| TGGACCTGCCCTAA | CACTCTGGAGGGTA | CTTGGAGGGGGGTA | GCGGATAAGTGCTG |
| CAAAATTAGATCGC | AACTGAGGCTTGGG | AGGCCTAGTTAAGA | GCCTGGATGGCCGT |
| GGTATGGGGATGAG | AATAATGGAACATG | GCTGCCTGGTCAGA | TAACAAAGTATCAA |
| GATACGAGATATAC | TAGAGGTAGAGATG | TCCGATAAATAGGG | ATACTTAGCCCGGG |
| CAGCACAGTACTTG | ACCTCGACTGAAAT | CGTGCAATCACTGG | AGTATGAAGCGCTC |
| ATCCCCTGAATCCC | ATTAGGATCGACCC | ACATTGCCCAGTCG | CACTCAGGATACAT |
| CATTGAGGACTGCC | CACTTGCACGGGCT | ACCGTACCTGAGAT | CGGTCATAACTCAG |
| GCGGTGCTACCTGG | ATTGAGAGGTACCA | GCGCGTGTTAAGGC | TACAGTAACGGGTA |
| CATAGTCCTCAAAG | GATAGATAGACAGT | ACAGGTCTCTCAGC | TAGGGGTCGATAGC |
| CCTGCATGCGCGTG | GAAGCATGGGCATT | GAAGTAGAGTCCTG | TCCAGAGCGGTATC |
| CCGGTGCAACCATT | GCAAATCACTCCTG | GTGACCTCCGAAAT | GAACAAACATATTC |
| CGGAAGTTGATCAG | TGCGTCCAGGCTGC | ACGGTCCTGATGCA | GCCCTAGCGTGCCT |
| GAATCTACTAACCC | AGGTCGACGCCATT | TGGACGCTTGAAAA | CTTACCACATGAGA |
| GACTCCCACTATAC | TGGAGGCAAGTGTC | CGTGTCGCAGGTCA | AACCGCTTAGTCAG |
| GGTCTCAAATCGAC | AACCCCGATTAGTG | ACGGTCAGGCTGAT | AACGTCCGTGCATC |
| TTGGGACTAGGGCA | TTGCCATGCGACAC | TCCGACGTACTCAG | TTGAAACACCGTAA |
| TCCTGCGCTACCAC | ATATAAAGCACTAA | CTCGCAAAATATAC | TGAGATAATAGGAA |
| TCACGTCCGCCATA | GGCATAATAGAACT | AAGCTTTAACACCA | CTTAGACAAAGGTC |
| GCCCAGACGTTGGT | GTTAGCGGCTCCGC | GCGGCTAGCGTCTC | CCCGTCAGATTAGG |
| TCACGTTCCCAACC | CTACCCCTAAGGTG | TGGATCCCTCAGGA | CGAGGGTACGTAAT |
| CAGTGGAAGCGTCT | GTATGACAAGTAGA | CTCAGGCTCTACAC | CACGTCTGGCGGAT |
| AACACTGTGGGGTG | TACCTGGCGCTCCC | TCCTGGGACCAAAT | CGTGGTGAGTGAAG |
| ACTATGTGGGGACC | TCGCCCAGCGGATT | AGGTAGCCCTCTGC | ATTGAGAATGGAAC |
| TATGTCAACCGGCG | AGCGCAGATTGTGG | GGACGTTTACAGAC | TTACGAAGTCACAG |
| GCCTGTACAAAACT | CATGCATCTGACAA | ACTTGCGCTGGGAC | TCTGACGTACCGCC |
| CTTCCAGATGCAAC | TGCTAACCTACCCG | ACGATTGAGCCAAT | AGGGACTTGATCCC |
| CCCAAGATTAAACT | CTACTGTAGAGGGA | AGATTGCACCGCGT | AGTAGTCCGGTAGC |
| CTTAGTAACAAGCG | AGTGAGAACAGGTT | GACCGCTCGTTGGC | GCTTGCCCGAAATA |
| CACTTCAACCCTCC | TAAGAGAACTCTCA | TCACAAGTATACGC | TAGATTCAGCACCG |
| AATTACCGTGGCAA | TGCTCGAAGGATAG | CCGGCTAAGTCGGT | CTGTCATGCGGCGG |
| AGCTACATAAATGG | AAGAAAAGAACTTT | GGATAATGAGGCTC | AGACTAGTGATAAA |
| TCAGGCGATGACTA | TTCGCCCTAGCCCA | ACTGAGCCCAGTGT | CAGTCTAAATCGCG |
| AGTATGTCCCGCAG | CGGATCATCACAGT | CAGATTAACAAGGT | TGAGGTTGGACGAG |
| AGAACTCTGGGAGT | AAGCCGATTGGATA | ATGGACGACCGTTC | TCATTCACGGGGAC |
| ATCCTGACCGTGGG | AGATTCAACGTAAC | GGGGACTCCTCTCA | CAGGTAAGCCATTG |
| CTGACATGCATGAG | ACAAGAGCTTAGGT | CCAAAAGTGATTGA | CGGTGCTAGTGAGC |
| CAGAAAAGTTCCCT | TCCGGCATTCCGGA | GGCGAGTTCGCCTC | ATGCACACGATATA |
| CAGTATCGATCGGA | GTCCTCAGCCTCCC | ATCGTACAATGCAA | GATTGCGTACCGAG |

FIG. 7 (Cont.)

| | | | |
|---|---|---|---|
| CTCCGACAACTGCT | ATCGTCCGACATCC | AGAAGTATTAGCTC | TCATCTGAACCGGT |
| CCACGAGATTGAGT | ACGCCTATATGCGA | CGCCGATTATTAAA | CGCTACTGCTGTAA |
| TCGTCGCCGACCTG | ATCGCACGCTGCTC | TGCAGTATCGCCGT | TAAGTGACAGTTGG |
| TCGGGCTCGTGGGC | TCATTGGGAATGGC | CTAATATCAATGCA | CAGAGGTGAATTTA |
| AGGACGGGTAATTG | CCTTACGCATCGTC | GGGGATGATGGTCT | GCCCCTCATTCGTA |
| AGTATGAAGTAGGA | ACGGGTTGAGATGT | TGTGCGCGAATCTG | CCCTGCTGATACTG |
| TCTTAAGAGACACC | AGAATGAGGGCTTT | CCGCTTGTTGCAAC | AGTTGTCGGTGGAA |
| GCGCGACTTGAGCT | GCTCAATCTTGGGC | CATTGGGGGTATCA | GGAGAGTTGTGTGG |
| ATTGCTCCGGAGCA | GTATGCCTAGCATG | CATAAATCAAGATT | TGCCAGCCCTGTCT |
| GTCGTGCGGAGGGT | TCAAGTCTTGCCAA | GGCCGTAGTCTCTG | GATCATTAGACTGA |
| ATGGCTACCGTCGG | AATATACCGTCAGT | TATATGGACTAAAC | GTTGATACAACGTC |
| AGGATCGGTGGATG | TCAACGTCTCTCCC | TAAACTCCTCCAGT | AGACGCGGTCTTTA |
| CAAACTCGGTCGTG | ATCGTTGATCCGGG | CTCGGGTAATGTCC | AGCTTTAGAATACC |
| GGCGCTAGCATCCT | GTGTATGACAGGCT | GTATGTAGGACCGT | TTCTGCCCATAGCA |
| AGAGAAGAAATATT | TTTGCAACGTGCAC | CTCCATACGTTAAA | ACCTGCCTCCGATT |
| CGTTGGGACGTAGA | ACCTCTGGCACTTA | ATTGCAGCCCACTT | CTCGTCGCGAAGTT |
| GGAACGTCCCCTTA | GCTAAGGATGAATT | CACATCTCCGACTT | AGAAGCTTACTTAA |
| CGGTGCTGGAGGTA | GCGTCTCTCAATAG | ACTCAGCGGTATGT | TTGCTCGCCAAAGT |
| GGGTAACAGGACTT | GCCAATATGTCACT | ATAGATCGTGAGTA | GTTCTTACCCGCAA |
| ACCTCTCTGCACGG | TGTAGGGGACTCCT | TTCAGCCATCGCTG | TCTTCATACCAGCC |
| CACGGTAACTCGTG | ACTCAATCTAGACT | GTCTATGCCGTAGC | GAGCGAATTCTAGT |
| GTCTAGCATGGAGG | AGGTAATCTCACTC | GCCGTAGTTGTGCC | AAGGCGAATTTGTC |
| ATCGTCCGAGCGGT | GTGCGTTAGGATCG | ACTGCGCGTCTAGT | GAAGTCCGTTAATA |
| GTGCGAATACTGCC | ATCAGAGCCGTTAT | TCTGAGTTAAAGGG | ATTTGACCATGAAA |
| CATCCTAGGCTCGA | ATCGCTCCGCCGTT | CCACGCTTGGATAT | TATACAGTAGTGCA |
| CTGAACGAATCTCG | TACGGGGATACGTT | TGTCAATCAGCATG | AATCATCACTGCTC |
| TATGTAAGAACCAA | GATCAACTATTCGC | ACTATTGGTAAACG | GAGACGGGATTTTG |
| CTGAAAAGATCTAC | TCAAGTGTATGAAA | TCGCAATGATTGAA | GATAGCTTCGGATA |
| AGATTACCCCGTAA | CTCCCGAGTCCTGT | TCTTCCGGACTAAG | TACGGACGTTGTAA |
| GATCGCGATATAGC | ATGCTGGTGCCAGT | TCCTGGTTCCACCA | TCCAGTCCAGGGTT |
| GCCACCGAGATTGT | ATAGTGCAAGATTG | CTGATTAGGTAGAA | AATAAGACTGGTTG |
| GGTATCAGATGACA | ATAGGCGTCTAGGT | GTGTCATGGCTAAG | AGTGACTCGCATTC |
| CGGTGGCATCCTGA | TAAAATACCTCTGG | ACGACCTCTAAGTT | CTCCCGCTTCGCCT |
| TACTAACGAGTGAA | GCTCCCATCATCTG | CCTAGTAGATGTCA | TTGGCTGAGCAAAT |
| TCCGCTCCCAGTGG | GCAACTGAATATGT | AAGTAGTTGAAATC | TCCCCACCTTGATA |
| AGATAGAGTTGAGA | GCGCTTTGCGAATA | ACTTCTGACAATGG | AAGGAGTGTTCTCG |
| TAATGCACGGTGCG | CTTAGCGGAGTACT | CCGAATTAATAGGT | ACGGTGGCGTTTAA |
| TCGTTCAAACAACC | TAGCCGGTACTAGT | TACCGAATCAATTG | CTTCACATCGGATG |
| TAGGAACTAGGATC | CGTTAAGTTCCGCG | GTCGACGTGGCGTT | CTTTTCGCGGGCAC |
| CTCGTTCGACAGAA | CTATCTGGCTCAGA | TGTAATGCGAGTAG | TTCGGGGTATCCGG |
| CGGGACTGGATGAT | AGGATTGGAATTGG | ATTAGTTCGCCAGG | CTGCCTGGGTTCAA |
| ACTGTGCCATGCCG | GATCTACGTAATGC | GTCACCTGTCGATA | TTGCCTAAAGCTCA |
| GTTTACGCGAAAAG | TCGTCCGAGGTGTA | TTTGAAAGCCATAG | ACCTAGCATTAGAT |

FIG. 7 (Cont.)

| | | | |
|---|---|---|---|
| GCTTCCCACTTGCA | CGTTGTCTAGAACG | AACCGTGTCCTGTG | CCTTGGAAATTGAC |
| GAACAAGTCTTTCG | GCTGATCGCGTTAA | GGTGCTTCTGAGCG | GACTCCTGTGCGTC |
| ATGCATCAATATGG | TCGGGATTGCGGTA | ACTGTCTGTCCCAC | TAATCAAACCCATT |
| AGCATTATGTACGC | TGGGCGAACGGTTT | ACTAGTACTCATGA | AAATGGTCCTATAA |
| AATAGATCACGTTC | TAACCTTCAGTGAA | ACTCTGGTCTCGAG | ATTCTGGGCCTCAC |
| CGGATAATCTTCCG | GACATACCTTGAAT | CTACAGCATGCTGT | AATTTCCGAAAACT |
| AACATTACGGGTGT | AAGAAATTTCACGT | GTGTCTCAGGGATG | ACGCTATAGGAGTT |
| TCACATATGCATCA | ACCCTAGGTACTAT | CGGGTGTGGTGCTC | TAGGAGGAATTTAC |
| AGTCTGGCCTTGGC | TACGCATAGGTGTA | CAGTGGTCACACTT | CTGCAAGCATATCT |
| ATTAAAGTAGCGGT | ATCGGGGTTCTAAC | GCCTCCGCGTCTTG | TGGGTCACTGCCTC |
| ATCATTCCCCATAC | GAGTGCTGCGGGTT | TGTACGTCCCATGC | GGACGACTTCGTTG |
| TCTCGCCCATCTAG | CCTCCCTCCGAATT | GGAATACCATGTCT | GACACTACTCTGGT |
| ATCACGTGATCAGT | TGCCCTGCGTTGAA | GCCTGATATCATCC | CCATGTCGACTTAC |
| GATAAACACATTAT | AGCGTGCCATCTAT | GGATTCGTGCCGGT | CCAGGCCTTTGACT |
| ATCAAACTGCATTA | TAGCTCAGGTGAGT | TCTAGGCGGTGATA | ATGCGCTCGCGTGT |
| GAGGTATCCTCCAT | GACCCTTTCGCGTA | AATCTCAACCGTAT | GATAACTAGTAGTC |
| AGAATTTGCGAGCT | TTTAAGGTCGAGAC | ATAACACTTCCGTG | GGATATCTGGGTGC |
| GCTAAGTTCCGTCC | CTCGGGCTTACGTC | TCTGTACCGCGTCC | GCTCCGCTATAGAT |
| AGCGGTTCAATCTG | AGTGGGATGTGTAC | ATTGCATATACGAC | CCTCTCCATAACGT |
| GATTGGGATGCTAC | GCTATGTCAGCGGT | GTGGGGAAGTATTA | ACCCGTCAAGTCTT |
| GAGTACTATGTCCA | ACCGGTAATTCCCT | TATGAGGCCTGTGG | ACTGGTCCGTGAGT |
| GTTACCAACCTTCA | CGTCCACTTGGGAT | GGTAGCTTCCTGGG | GTGCATGGGTAACT |
| TCCACCTTTCAGAG | CATCAGTACCTCTA | TAATCGATATAGCC | TCTTGAACTAACGG |
| TGAAACTATCTAAA | TTAGACGATATGGA | AAGCTCGCCTCTTC | CTGCGCTCTTAAAC |
| GGAATATACTATAC | CTGCGCTATATGGC | TATAGTATAACGCA | TCTCCCAAGATGTC |
| TATGGGTAATGAGA | GTGGTTGGAAACAT | TCGTCAGCGGATGT | ATTACTAACCACAT |
| CTTGCTGGACAGGT | TACCTGCGCTACTA | CACTCTTGCCGATC | TTTACAAGCGATGA |
| TTCATCGTCAGGAC | TTATACCAGCCCTC | TTTCAGCTCCGACA | TAGTGTTGCCCGCA |
| GTGTGAATGTCCAA | CTGCTCCTGGAATG | CATACCAACTTAAT | TGAATGGAGCGTCT |
| GTAAACCTAGTTGA | TCACTGTGCGTCAA | TCGTAATGGCCTCC | ATGATGTTACCCCA |
| GTGTCGTACGAGTG | TGTGAACAAAACTT | GCTGCGTAGAATAT | TAGAATTTAAGGAA |
| GCTTAAGTCCGCTC | GGTGTGCCGTCGTC | TATTGCCAACTAGG | TACGCCATAGTCTG |
| GTCTTGGCGTCGGC | CCTTCCAATATAAC | GTCCCTCGCGATCT | GCGTTACCCATATA |
| AAATGCGCTCTTAG | TGTTGATGCAGCAC | GCATTGTCCACTGC | TAGTCCGCCATCGT |
| CGGTCGACTGGTTA | TCTTAGAATCAGAC | CTTGCACGGTCCTG | GTACACACTTTCGG |
| TAGGGCTAAATTGG | GACACTTAATCCGT | GGCTGTGTCCCCCT | TGGGCTTTGGAGGG |
| TTGACGGGCTGGGT | TATGTAGGTAGCGC | GAGTGATTCGTCGG | TATGGCGTTCAAAG |
| CTAAAGCACTTTCC | TACTCCGCCAATTG | TTCCCGTCTACAGG | ACGTCGCTGACTCT |
| ACAAGTTCAAAATT | GCGGGTTCTGTCGG | CATATTCAGCGCTA | CTACGTCCTATGAA |
| TCATAGATTGCCCC | ATTACACCATGCGT | GTGTTCACCGCTGG | GTTTCTAGGCAAAC |
| CGTCCGGCATGTCT | TTGGCAGACGTTCC | TAGACGGTGTACGT | TTACATTGCCGAAC |
| TTCTAAAAGCATCG | ACTGCGTCCTCCTC | CTTGGCAAGTTGAA | GATCTTACACCACT |
| CGTGCAGATTGGTC | ATCCTCGAATCTAC | GCTGAGATAGTTGG | GGATAACTCCTACT |

FIG. 7 (Cont.)

| | | | |
|---|---|---|---|
| AATTCGTTACCAAA | ACAATTGTGGCGTC | TGCCATTCGACAGT | AAATATTGGACGTC |
| TAAACGGTGGCATT | GGTCTAGTACCATC | AATGTGTGAACTGG | CACGAGATTAGTTA |
| AACAGTGAATAATT | AGAATTTAGTCAAC | CTCTGACCCCGGTT | GTCTGGCGATACTC |
| CTATACGTTACGGC | AAGGTAGATGTCCT | ATATACGAATGATG | AAGCCAGCTGTTTC |
| TCACGGTCTGCAGT | TACTCGCTCTAGAG | CTCTCCTTGCAAAG | CTCCAAACTTGTGC |
| ATCGCCTCACATTA | TATTCACGGCTCCC | GGGTAGTTCGGATA | CAACGCCTCTTCGT |
| TAAAAATGATGGGT | TCGGGTCGAATGGT | TAGTTTCGCGGGAG | TCGGATCTAGGCAT |
| GATGTAACTACGAT | GAGTGAGTGTACCT | CGACTTTACTGAGC | GATGGAGTAGTGGT |
| TAGAGATTGTAAAG | AGTGTAGCTAATCG | TCTGACGAAGCTTA | TCCGTATGGCTCGA |
| TGCGACTGTATCAC | GTGACCTTAATAAG | CATCGGCCTTTGGG | TACTTGCTAAAAGA |
| GACCCACTTATAAT | TATTGCACGGAAAT | AACTCCCCCTCTCT | GACCGGGTTTGTGC |
| TCGAAGCATAGATT | GGTTTGCCAATCCG | GTCAAAATTATCGG | AGCACTTTGCGTAG |
| GTAAAGGTTCCGGT | CAGTCGTTCCGCCT | TTGGGGATTAGGAA | AACTTAATCAGTAG |
| GGCGTCATTCGCCT | GACTGGACTGTGTC | TACTGGTCAGTCCA | CTGTTAACTCCACG |
| TCAATAGCCTAGTC | ACCATTTTGACCAA | CGTTGTCATAAGAA | TTAAGGATATCACA |
| CATTTATCCAACGC | CAGTGCAAGTTCTA | TTTCGGGGTAACCA | ATTGTGCGCCCCGT |
| CCCATTCGGATCGT | GCCAAATTTGATAA | ATGTACCATGTAAC | CAGGCATGTTTGCG |
| GCATCTTAACGTAC | TGACGGGTTGGTGG | TGAAGACACATTTC | CAATTCACTAAGAT |
| GGCTTTCCCCCGTA | AACTCCATTATCGC | GAGTGAAATAATTG | ATTTGCGAACGACT |
| CCGTGGTCTATGGG | GGTTGGTAAGTGCC | GCGTGTATGATAAA | AACTTCATGGATAA |
| AATTTACTCGCGGA | ACCAATGAGTCGTT | GAACTAAATACTTC | TTAAGGCACGATCT |
| TACCTCGGTGGCCT | AGTCTTTAGCGACC | CCGCTTCTCATGAG | GTAGTTACATGAGA |
| TCCCCCACACTTTA | CTTGTAGAATCGAA | TTACCCTTACGAGA | GCTTCCTCTACGAA |
| CCCTTGCGTGTACC | TAACACGTCATAGT | CCTTACTTGACAAC | TAAGACGGCCTTAT |
| ATTAACGTCTCACA | CGTAGAGTGAGTTA | TACTTCGACGCATG | TGAGAGGGTTCTGC |
| GCCTTTCGTACGAC | ACGGTGTCCGGTCT | AACAATTTCTCACG | CTTAACGAATAGTA |
| GCATATTGTACCGA | GTCGTGGCTAGATA | GCTTGACCTCGGGT | CATGGTTGTCGAAC |
| TGATTTAGCACGGA | TCATCTACTGCGAG | ACGTGTTGGACGGT | TATCGGAGAAAGTT |
| AGGTTAGTACACTA | GTGAGATTCTGACA | AAAGCCAACTTCTT | TACTTACAGCTGAG |
| TGCGCTCCCTGCTA | ACTGGCGCTTCTCA | TTCAGTCAGTACGC | CGCTTTACCCTACG |
| TACAAGTTCAAAGT | TTCCCCTATAGGAG | CAGCTCATCTACAT | CACTGAGGTATATC |
| ATGGCTGGCCCTTG | CCTATCCACACTTA | ATTTGACACCAGTA | AAATGCTATTGAAC |
| CGCCTAAGATGTTA | TATTCGAGCAGGCT | ACTTTCGGGGTACA | ATAGCCGTTTGACG |
| GTGCCCACTCCCTT | CCTCAACTCCCTGT | GACTTTCTCCGACC | CTTTCGGAATACGG |
| GAAGTGTTAGCGTA | AATCCGTGAATGTG | AGAATTCATAGGCT | AGGCTTATGGAAAT |
| TAGCGTCCTTGAGC | GAGGCTGTTCGTGC | AAGTTTCGGAACAT | TTGAGGCCGTAAAT |
| ACGCTCTCGGTTGA | TGCGATATTAGCCC | GTTAAACCATCGTG | GGTGAAGGATTCCT |
| GCGTTCTTGGGAGG | AGCTAACATTTACG | CCTACGACTTATAA | GAGATCTGGTTCAG |
| ATCTGTCAAAGAGT | TATAATTACGAGCC | AGTGTTTGCGACGC | TTGGTTACGAACAA |
| CTATCCAGAAATGT | GCTGGATTGTCAAC | GAGCTATGTATCCG | TGTAAGGAGATGCT |
| CAATGACCAGTTTG | CTAGGCCCTTCGTG | GTCAACATTAATAC | CGTCGTTAACCCAT |
| AGCATGTCGGAATT | GCCGTCCATAGTGT | GAGCTTTGGAAGTC | TTGGTAAAACTGGA |
| AAGTGGATAGCTTC | CTCACAGGTTCTGG | GTGTCGATCAGCAT | CTGTCAACTTGGGA |

FIG. 7 (Cont.)

| | | | |
|---|---|---|---|
| TTCAGCTTGAGAGG | CTGCGTTTAGCCGG | GCTATTGGGCATAG | TGAATCCTCCATCC |
| GAATTCTGAGATGG | TAGCCTGATCGCGT | CATTTCCGGTGAAA | CGGTGTGCCGTGTC |
| AGTAGGTCAACTAT | ATGGTATAAGGGGT | GGTCTGTGTAGGGC | GGAACGGGTATTGT |
| CGCTTGCTGAGCAT | CTTTTGAACGACAA | ATTGACAGTAGCGT | TTCGCCCTCTACGG |
| ACCTTATTGCAGAA | TAGTCTAAACAAGT | AACAGCTGTTTACC | ACTAGGTGGCTTCA |
| GTGGGCAATAGTAT | AGTCTATTCGGCCG | CTCTGCGAGGATTC | TCTCAGGGCTTCGG |
| TACTACTACATCCC | GAACTAGAGTATGT | AAATTGAGAGTCAT | CTGGTGCCGGTGTG |
| TGGTTCGAGCACAT | GTATAGATCGACTA | AGGATATCTACGTC | ACAAATAGTGATTC |
| GGTCTTCAATGACG | ACACTTCGTTCGCA | AACGTGATATTAAG | ATCATCGTCCATGA |
| ATTCAGACATCGCT | TTGGCCAACCCTCT | AATTACAGATCCTC | AAACAGATTTTCCC |
| GGGGCTCAACCTTT | CATCAGTGGCCTAT | TGCTGTTAGGCAAG | TCCAGGGGTTCTAC |
| AACGACTTTAAACT | TAGCTGTCAGCGCT | AAAAGTCCTTTCAA | CTAAAAGTCAGTTG |
| ATGATAGTCTAAGC | TCAAAAAGTTCTAA | TAGTACGCTAGGCT | TTCTCGAGCCAGGT |
| GTACCACCGCTTTA | ATGATCTCCCTCCG | TAGGACCTGTCTCA | TGGTGTGGTGGGGC |
| GGAACTTTCGGTAA | AGCGACGTTTGCAT | ATGGTTCGGGTAGG | GGCTATTAATGGGC |
| GGCAAGTGTATCTG | CCGTTTAAGCGCGT | CATAAAGGGGTTTA | AGTGCTAGACTTCA |
| GTTCGCATGATACG | GGTGTCACACGGTT | GGCGTGACTATTGC | CCAGGTTGATCATC |
| AGGACCCTCTATTG | ATGTGGTCGTAGAC | GACGTTCACTCGAT | TTCATCCGGAAATA |
| AGTTATCCGTACCG | CTCCGTATTGAGCG | GACATTTGAGATAA | CCTCTATGCTGCGC |
| GCACTCGCGGTATT | TAACTCTCTGCCAA | GACGACCCTTTGTC | TAACATCTGCGGTG |
| CTGCCCGATGTTAG | ACCTGTTAGCACTA | TGGGCTGTTACAAG | TTACTGTAGGCGCC |
| ATACTGATCCGCCT | CAGTCCCTTTGCAG | ATTCAATGATCCGG | ATATCGAGTTCACC |
| AGATTTGTAGGAAC | TGACTATTGCGGAC | AAGAAGCTTATTGG | TCTCTTAAACGCAC |
| GAGTCGCTGTATGC | CCGTTCGTTAACAG | CGGAACTGTTCGGT | GGCTTTTGGAGAGC |
| CGGTTATCGAGATC | TACTAAGTTACCGA | TCGGTCAACATTCC | GTAAGAATGCATCT |
| TCGAGCGGCTGTAT | CAGGATTTGCGCGT | TTGACCCTCACTGA | TGATGTACAAAATC |
| ACGCTGTTAAACAT | GCATTTGCCATGGA | TCCCGATCAGTTAG | CGGGAAGTATTGAT |
| CCGTTTACGATGCG | TGAGCATGTACATC | CTTCTCAAGACTCG | TTCTCGGGGGGCTG |
| CTTGTGACCTCCGC | TTGCGTATGGGCCA | ATTATCCCAACTCC | TCAGGATTAGATCA |
| AAAGTATTGACATC | TACTGAAGTCTGAC | TAGCTACACTGCCT | TCAGTGCTGCGCTG |
| GTGATGAGGTGCGT | CGTCCTGCTCACCT | CTGGGGTTGAATAG | CGGGACTAGTTATA |
| TATAGCGTACGGCT | TGTCTGGTGACAGG | CTCTGTCCGATACA | ATGTCCCCCTTAAA |
| CCTCTAATATCGCC | TATGGATTCAAAAC | CATGGTGGTTCGCG | TGCCGATGTGACGT |
| GTTTGGTCCGACCA | CTGCACAATCGTTA | GCAACAGTAATTTG | TGCTAAATGGCGCT |
| CTTAGCAATCAGGT | CGCAACCTTATCGT | GTGCAGCTTGTCGC | ATCCCTAAAACTTG |
| TATCAGGCTCATAC | TCGGCTATAATCGC | TCCTACTTAGCAAA | CCAGATACGTTATC |
| CTGAACCTAGGCTT | CTGGAAAGACGTTT | ATAAAAAGTGTCGT | CGGCTATAAAATGT |
| ACGTTGAGTGCTGA | ATGTATCCATCCCC | GATACTCGCTGATC | CTGCGAATCTAATC |
| CAGTTCAACTGGTC | CATCTGGTATAACC | CACTCTTAGACGGT | ATACACATTCTACA |
| GTCTATACTCCCGC | CCATATCATCGACT | TGCCCTGGAGGTCT | TCCTAGGCTTAAAG |
| CCGATTGGCCTGTG | AGTCTCAGCTCGCT | AGTGAATATGATAC | GTATACAAGTGTAG |
| ATTCGGTACCCCCT | TCTACTCGAGGAGT | CCTTGGGCCTCGCT | AGAGTCATACTAGT |
| TCATATCATGAGGC | CTCCATGAACAATT | TACGATGCGCGATT | TCCCTCCATTGGGG |

FIG. 7 (Cont.)

| | | | |
|---|---|---|---|
| CATGTGTTCGCCCG | CCAATCGGCTCTGT | CCCATCGTCGCTTG | TTGACATTACCGAG |
| CGATTATCCCGGCT | GCTGTCCTATCAGC | AGTTGGGTCGGACT | TAAGGGTATGTCGA |
| GCCATATATAACTG | CGATGTCCTACTGC | CATTGCTCAACTGA | ATGTGCTTGCACGC |
| AATTGATAGTAGGA | CGAGATGGGTTACT | CAAGAGATGTATTC | GCTCTAGAACTTAG |
| AGTTCAGTGGATGG | TGTTAGCCGCATAG | GAGAATAGCATTTG | TACTACCCTGGTGG |
| CAATGGGTGAGTGT | AGAATCCTGTGATG | CGCCACTTGTAGGT | TAAATTCACGAAGT |
| GATCTAATGCGTAC | TTATCGTAGACCGA | CTACCTATAACGAT | CCCTGCTGGCTTGG |
| TAGCAGGCGTCTGT | GGAGCACGGATTTT | AATTTGGTCGGCAG | GGGTTCGCCTTGCG |
| TAGACTTCTAAGGG | CGATAGAGTGTAAT | CGCAGGTCTGGGTT | TGTCTGGCTGGAGC |
| TTCGGCTCCTGAAG | CAGCCCTTGAAGTT | AAGTAAGTACTTGG | ACATTCTCTGGCGC |
| GGAGCGTGACTATT | ATGGCGACATCTTC | CGTAAAATATCCTC | GAAGTTACTCACAT |
| AGGTATCGGATCTC | CTACTCGCCGTTAC | TTAGTAGCCTCACG | GCGATTTGATCCCG |
| AAACCTACTAATTA | AGAAAATCTTTCGG | CACTGGGGTGTGCT | CCATAGGTCCATTC |
| GCAAGCTGATTTGC | GACAATGGGGTGTT | TTGTGTCGGGGAAC | ATCGCAGCTTCATA |
| ATAACGTGCGTTCC | GCCTTAGCCTGTAG | TACGTATTCGGGCG | GTAGCTCTCCTGAA |
| TCTAATCACCGATA | AACGGAATTTGGTA | CGGAGCTTTACTAG | CATGATGGCCCTGT |
| GTTAAGACCTGATG | TGAACTAGAACTGT | ACGGAGCTTATGAT | AGTCGTTTCACCAA |
| AGTGTCCAATAGTG | ACATGTGGAATCCT | CTGTCTGTGCGAAA | TCCAATCGGTAGGT |
| ATAAGTGAAACTAT | TACAGGCCATCATT | GTGTGGTATAGCCA | AGTCGGTGTCATCC |
| ATAGCCCCTGTCGT | TTCTCTACACGAAA | GATCGTCTCAGGTC | AGGCTTTCAGCATA |
| TGCTGAGCGTGTAC | ACAAAGATTTGAAT | GACGGGCTCCCTTT | TTTATAAGACGCAG |
| TACGCTCGACCTGT | ACCGTTAATAAATA | AACTAATGTTGCAG | CTGGCCTCTATGCA |
| GATCAGTGTGTCAA | ACTGATACTTAGCC | TTACCTGGCCCTCA | GCGTTTGCGGGTCG |
| TCATAATCCAGTGG | TACCCTAGATTCGC | GTGTCAGTGCGGTG | GGATTTTCGGAGGC |
| AGATAAACCATTTC | CCACGATCCTGTTG | TGCGGTCAACTATA | TGCTGGTATGGACA |
| TCGTCTACCCCTGG | TGCCGTTCGCTCGC | TGACGCTTCACTGA | GTTTGGACAATAAC |
| GGACGATGGTGGTT | ATTGATATCCGGGG | TAGACGTAGATTAA | GCGGCATGCATTGT |
| GCCCTGTGACCTGT | GAGTCGCGTCGTCT | TGGAGCACATGTTA | TTCAGTGCCATGGA |
| AAGCGTAAATTGGT | TAGACAGTTCGCTG | TGTACGCCCACATT | GCAGAGTAATTTCA |
| AATAGGTGGTAGAT | AATCTTAGAGGGTA | GCCCCTGATCGTTG | TCTACAAACGTCAT |
| GTTTACGATGGACA | CCTTGAAGAACTGT | TTGGGTTACAGCAG | CTGCCGACGAATTT |
| AACATATAATGGTG | GTCGTGTGTGAGCG | GTGTCGCTACAGCT | CTTGCACGGCTAAT |
| AGTAATGGCTAGTC | CCCTGGACGTATGT | TGCCAATTCAGTAA | ACGTGTCCCATGCT |
| GTTGAGCAAGTTCC | CTACCCGCTCGATT | GCGACTTCGTATAC | TCATCCAACAGGTT |
| ACAACTACTGCTCT | CGTCTGCACTATGG | CAAGCCACGTGTTT | ACTGTGACCCTCTG |
| GTGATAGAGTTGGA | AGTGTATTACAGGG | CAGTCTCGATTACC | ACGGCTTTCGCCTA |
| CTCTATCAGGGTCA | ATGTTAGGAAGAAT | GAATAGACATCTAT | TGATTATCGACAGG |
| CACATCATGTGCTG | TAACCTTCAACCCT | AGGCGTATTAGTCG | CCCAATATTTACAG |
| AGAGTCGTTGCTCG | GTTACGCCTTAGGG | TTGACGGTCGTCCA | GTCATGTACATAAG |
| CCCGAGTCTGTCTC | TACATTTGGCGCCC | CATAATGTAACTAA | CCACCGACTCTTTG |
| CATAGAGATGTTGC | ACTCGACTGCTCTA | AAAGTCGTTCGTAA | CACCTCGTCTTGGC |
| GAGAGTCATACCTT | ATATGCTTAAACCA | GAAGTTGTCTGCAC | AGTAGATTGCAGTC |
| CGGTCTTCGGGCCT | TTAGCTGTGAGCAA | TTAAACATACCCTA | GTACGCTCCGTCTA |

FIG. 7 (Cont.)

| | | | |
|---|---|---|---|
| CCGTTCCTGGCGCT | TGGACATATTAACA | TTATCAGCGAGAGT | CGCGCTGTTCGCTA |
| ACGTTTCGACCGAT | CTACCGCCATTCTC | AACAAATTCGCTGT | CCCCAGGATTGTCT |
| GTGCTTGATCACAA | ATCTTGACTCGCCG | CGCCAACTCATTTC | TCTGACGGTACATG |
| TCACCAAAGTACTT | TAGGCTGATTCAGC | GCATATCTGCACCT | GCCTGAACTTTCGC |
| CGTTAATATAGCGG | TTTGGTGCCAAACA | AGTCGGTCATGCGT | CGCGTCTATAGGTG |
| TATGCAGCTAAATC | CACGATCTTTCCAC | CGGTGACGTTAAAT | AAGAATGGCTTGCT |
| GTGCTTGCTCGACG | ACTATGGTTCGCGG | GATAATTCGCGCAT | GTGAGCAGGCCTTT |
| CCCCGTTGTTGACG | GTCTCCTGATGGAA | ACTAATCTAACCCT | CTACTTAGTGCGCC |
| CCTGCGAAAATCTT | CAATTGTGCAGGTA | GTCCGTTCGTAGCA | ACGTGTGACTTAAA |
| TGTCACACGGGTAT | TACGGCGTGATTGC | GGAATTCCGATGTG | TAACTACATTCCGC |
| AAATCTGCTGTGCC | GAGATTCGTCTGGG | TTGAACCACCTCGT | CTGAGCCCTGTGAT |
| AGGTCTCTTCGAAG | CGGTTAATGCCTAA | TATAACCGTAGTGA | CATCGGATGCTCAT |
| CGACCGTTCCTAGT | GAACGCTATCGTTC | CTTGTACTAGGAGC | CGTGTCCCTGGGTC |
| TCCGCGTCTCCTCA | CTCCTTCTGCGAGG | TCTGCGCGTTAGCG | AATATGGGTAGATC |
| AGTAGTAGTTACGG | CTGTGCATGAATCC | CTCGAGTGCATATG | GCGGTGATGCTCGT |
| GTGATGCAGGCTAT | CAATCTTCTAGGAG | CTATTGCATCGAAA | GGCCTGCTATATCC |
| TCAGCTACAAGTTC | GCTGGCACTACATT | GGTGGTTAGTAAGA | TTCGCACAGAGTTA |
| TCCCTCACCTACTC | TTAGCGCTCGCCTC | ACTACAGTGTTACA | TTGACACCTGAGTG |
| ACTCTTAGTGGCAG | TGGGGGTGTCCTAG | GCATCACAATTACT | CACGCTAGTATGTA |
| GAAGTGATCTTACC | GGCCTTACGGTGTC | GGGTGTGACAGTTG | AAGTCTCGTCGGTA |
| ACGGTTATATAGCA | GTGTGGAGTCCGGT | TTAGCCGTGCCGTA | GGGTATCCCCCTCT |
| GGGTGATTAACTAA | TGTAATGCGTCGCA | ACATGGAACATCTT | TAGTTCAAAAGATG |
| TTAAGATGTAGGAG | CTGAGTGACATGAT | CTGGGACTATGCTC | CAACAAATTTTGGA |
| ACTAAGCTCTCATC | CCTTAATCCGATAA | TGTCACGGTACCGT | GTGGTGAGATATGC |
| CTGGCTTGAATAAA | ATCTTAAACCCGTG | ATACTCTCGGTCCC | GAAACTGTCATGTC |
| AAACCGCTTGTGAT | TCACTCGGTGAGTC | TATCAACTAAGACT | GTCCGGGATCGTAT |
| GTAACGTCTAGGTG | TCACAACAGCTTTC | ATTGGGGGATGAGT | GGTGAAGTGATGTG |
| ACTGTCGAGCCTCT | ATCCTCTGAAAATG | CTCAATGCTAGTGG | CACTTCGAGACCTT |
| ATTTGGGTGAAGCA | CGCGGTCCTTCGAT | TTGGCTCCGAGTAC | TTATGGGCGTGCCA |
| TCGTCTCGCAAATA | CATTACCTTGGACG | ATGGAATAGAGTAT | CTGAACGTGCCTTC |
| AGCTATTATACCGC | CCCGTGCTTACTGA | CACTGAATGGTCTG | CATAGTGGCGAATT |
| CTGGGTAGATAGCT | CGCCACATTAGTCT | TGGAACGCTCATAT | CCAATGCTGGTAGT |
| CCTCCACTTATGCG | CCTGCAGGCTTCTC | ATTCACGAGAGTCT | CGTTTAAGAGGCAT |
| ACTCCTAGGGTATG | CATGTGCTACATAA | ATGGGATGCTGCGT | GCATTCTCGGCGTG |
| CCTTTACTGACGGC | AACTAACTGTATCG | ACATGAAGCTTATC | AAGAGCTTACTCCT |
| ACTGTCGCATAATC | CCCCACTTAATCTG | CGACTGTTCCATAA | CCCCTTTCGCTCCA |
| ATCTCAGTCTCCAG | CATGATTCGACTAC | CTGGAGATAACTCT | GCCACTCTGTGTGG |
| CGCTGGCCTGCTCT | CATTGAGAGTTCAG | TGTGCAGAATAAGT | GAGGGTATAATGCT |
| AACTTTGGGCCTGG | ATCAGCATGCTTCA | ATCGCGTTCCGTCA | CAATTGCTCGATGA |
| CTCGTAATACATGG | TGTTAAAGATCCCG | CACGGGTTGCTATA | TAACCTTCGAGATG |
| AGGACTTTGAATCA | ATGCTCCGGAGATT | CAATCTACCTTAAG | CGGCATTTACGCTC |
| ATGTTAGACGTGAA | CAGAAACTATTGTC | GCTCCATTCTGACG | GGGTTCCGTTGCCC |
| AAAGATTTTGCCCC | CAATTCATGGTAGG | GGTTGCAGACTTGC | TGTAGAGGTCACTA |

FIG. 7 (Cont.)

| | | | |
|---|---|---|---|
| AAAGTACGTATAAT | CACTTTGGCATGCC | CCAAGTTTATAAGG | TGTTGAACCGGGTG |
| TCGAGTTCTAACCA | ACCCTCGTTAAGTA | GGTTCATGCTACGC | GATCTGGAGTTGAC |
| ATGTTAGGTACCCC | TCAATTAAGTGACA | CTTGATACCAATGG | CTGGCGTGTGTAGG |
| ACTCGAGCGTCCTT | CACAAATTTTCGGC | GCTTACTGCGCATG | TGCGTGCGTCGGTC |
| ATGCTACTACTGGG | AACAACGTTTCTGG | ATGATCTGTGGCCA | TGACCACAATTGTG |
| TTGGTCGATAAGAC | CCATGTGTTGAGGA | GGGCTTGTGGTGCG | ACTCCAATAGCTCT |
| CAGTTGTGCCCTGG | CAGCATTTCACAAT | CCAGTACTCATGTA | CGTATCATCAATAC |
| AGTACGATGTACTG | TAGCAGATTTACGA | GTGGAAAATGGTTG | CTTGACGCTACAGT |
| GCTTCGTGAAAGCT | GGTAAATTATCAGG | GTCAAGCATGCGTT | TGAGGCTTAAATAG |
| TGCCACGTCGGTTG | AGGCTGCTGTTCGC | TCCAAATTAACTAC | CTTGAATTGAAGCA |
| CTACTTGCGAGATC | GGTATAGCCCGATT | TCGAATTATCGCAG | GCAGCACGTTTCTA |
| TAAGATTTGGGAGG | AAGTTAGAGGTATG | TCTCGCTACGGCCT | GTTGTGCCCAAATC |
| TACCCAGGTTCGTA | AGACAAATGTCTTC | TGGTGTGCAGGTAA | AGGTCACCGGTTTG |
| TTGGGCTCCCTCAA | GTGCAATCTAGCTC | ATCTCATAATCAAA | GGTAATGACGCGTT |
| ATAACTCACGTTAG | TCGTAGCCGATTAC | TGCTAAACTAGATA | AGCTTAGGCTTCCC |
| GCGTTCAGACCTTG | TACGCATCTTACCG | ACTCAGAATGTCTG | AACGTTAGCTATAG |
| CGATTAAACTCGAT | AGTGGGTCGGTATA | TGGTCGGCGTACTC | AATGATAGTCGCTC |
| ATAATTGACGTACA | ATCGCGGTGGTATG | CGCACTTTTACCCG | GCCACGTTCGTTAC |
| CTGATTTACGGAAC | TGGGTGCTCCGGCT | TCCATTAAGGATCC | GGTCCTCGCATCTC |
| GCACTGTTCGTACG | GTATAGCTATGGAG | CGCATTGTTGCGAG | TCCTTTACACCGGC |
| CTCTCATGACAGTG | TATTGAATGGGCAC | ATAATTAGAGGATC | AGTATTCTGAGAAA |
| TGCCTGGTGCACTG | AGTGAACGTGCTCT | AAGTTATCCGCCTA | GACTCTTCGGATGG |
| TCCTTACGTGGGGA | ACCAGTGGTTTAGG | TATAATCTGCCCCC | CGCGCATGATTACT |
| AAATGCGAGTCTTA | ATCTGAATTGGAGC | TTGGCATCAAAGGT | CTGCGGCTTGCTAA |
| GGGTTCGAGTAATG | GAACTCTGCTAACT | GTTCATAACAATAC | CTAGAATTAGAGTC |
| CTACTACTATCGAG | TGATCGGAGTATCA | CCGGACGAATGTTT | AGCGTCTGTTGAGC |
| AACAAAGGATTTGT | TCCGTCGAATTCCA | CCACTACACGTTGT | TATCTTAGACAAGG |
| AGTGTACTACGCCT | AGTCTTTCCAAACG | GTGCGGAGCGGTTT | TATGCACCCAATGT |
| ATCTACCCAACTGT | GTGATCCCCTAATG | CTCATAAAGCCTTC | TGAAGAGAATTGAT |
| TGGGACGAGCTTGT | AATCTGCAGTTCCA | TAGTCTATCAGGGA | TGCGGTCGAACTTG |
| GTTGGATGATACCA | CTTGACATCGTGAC | CTACACTACCATTC | GATCTTGAAGGTGG |
| AGTTGTTAACGGGA | GATAGTTCGTCCCC | TGCCACGGTCAGTT | CACTATCATATCCG |
| TCATTAGCTGCCGA | TAATCTGGAAGTGC | TTTAGAACTCGGCG | CTGCACATTTCGCG |
| GTTTGTCACCAAAG | ATCCCACGTTGGAT | TCAGAATTGCTAAG | TCTTAAGGGAACTG |
| CTGTTGGCCCACTC | ACGTAATTACTAAA | TTAAATATGCACAG | TGGGTTCCGGACCT |
| TAGGTAAGAGATCT | GTCGAACCTCTGGT | TATTCCACGATGGA | TGTACGGTGCTACG |
| GCGTGAGACCTTAT | TTCTGAAGAGATAC | ATTGGCGCATATAG | ATAGCGTCTAAACT |
| CAATTAAGCATTCG | CATGTTACCAACTA | TTAATAAAGTCGAG | GAGTGTATTGGCGA |
| CGCACGTTAGTTCA | AATGATTCACTAAC | TCTCAAAACACCTT | GATGTACTCCTCAA |
| GAGTCCCACTTCTG | AGGCTTTAAGTCGG | GATTGGCATAAAGT | CTGTCCTCATCCGG |
| TACAATTAGCATGG | GGCGATACTTATAG | ATGGTGGATAGACT | AAGGAATTGTTCAA |
| CTCTCTCCCTACAG | GTTGCCCTCCGTAG | TGCGTCGCATGTGG | CGTTTACACTCCCG |
| TTTAGACCGCTCAC | CTAATAAATGCTCA | AGCTCCGTCCTATG | ATCGGTAGCCTTGA |

FIG. 7 (Cont.)

| | | | |
|---|---|---|---|
| CGACCTACCATTCT | TTCCACTAATAGCC | ATGTAAGAGACCTT | AGTAGTCAACTTGG |
| TTGAAAACGATAAT | TTCACAATGCGCAT | CGAGCATCCTCTCT | TCTCTAGAGTACCA |
| TCGCGTACGGCCTT | TCCCGTGCCATATG | CGACCGTCTTTCCG | TCTGCCATCGAGTG |
| GTACCGGAAGGTTT | ATAGATACTTCCGA | CTTAGTCCCTACCA | TTAACTCAGGCCTA |
| TCATAACCGTGGCT | GGGATCTGTAACGT | CTCAGAGTAGGGTT | TAGCTGGGGAGTTG |
| AATAGTCGACATAT | CTAGTTCCGAAACT | TAGCCACTTCCGCT | ATCCGTAATGCGGT |
| CGTATGCCATGCTC | AGTATGAACCTAAT | GTATCTTCGGACAA | TATATGACGGGTCC |
| GTTTGCGCGACTGC | GGGGCTACTTCTGA | GACCGTTCATAATC | GATCAGTGTACACT |
| AGGAATTTATACCG | TAAACGTCTTAAAA | TGATAGGAGTGCGT | TGAGTAAACTAATC |
| CTTGGCCGTAATGA | AAGGATGTCCGTCT | AGTCCTGTGCTAAC | CTCACCTCGATCCT |
| TCAACAATGGGGTT | CCGGTATAATTCAA | GTCCGTAGTTGAGC | ACGTTAATACCTGC |
| CACCGAGTACATTT | ATAGCGAATCGCTT | GGTGACGTCACTGT | TCCTAAGTAATGCG |
| GCCTGCACTTATAA | TGGATTTCGACACA | TTGTATCGGGCCGG | TAGTGCGCGACTAT |
| GGTGCCAGGTCCTT | ATAAGGTATTCAGA | ATATGAAGGTAGGT | TACGTTCCCAGAAT |
| TCATCATAGGTAGA | AGTCCTGGTCTCGG | TAGACCTGGCGTTG | TCCTTGGATGAAGC |
| AGGACCCTTTCGCT | AGACTAGTGTGTCG | AGATAGAACCATTT | ATCTCCATACACTG |
| AGGTACGACTCTTG | GGTGTACGTTGCAG | TTGTTGGAGCGGCC | CGGCCTATGTGCAT |
| CTGATATAGAACTA | GCCCGTGTTCGGCT | TTGCGGTCTCACGA | GATCCCTCTGTGCA |
| ACTTAGGGTTAGGA | ATATCCCTATGGGC | CCAACACTTTTAGC | AGCTTTGAACTAGG |
| GGTCATGGTCGGTC | GGTCGCGAGATTTG | TTCCACCAAATGTA | TGCAAGTTGCGATA |
| CTGGTCGCTTACGC | TTGATGAGAAACTG | CATATGACTACCCT | TATCCTGTCGGGGC |
| TCGGGCTTGTCCAG | CTTGGATACCGATC | GCCCGTTCAAGTGT | TAAAAACTACACTT |
| CAACGGCTTTCTCG | AAGTTTCGAGCTCC | AAGTGTAGCTTACG | TTGGTACGGCGTAG |
| CGTCATTCGAGGTG | AGATCCATAATATC | CACTCGTCCTGCTA | GTAGAAGTCTTAGC |
| ATCTCAAAATAGCT | ACTGCAATTGCGTA | ATAACCGTTAAAGT | CGATATCACGTTAA |
| TACTTACGAGGTCG | TAGTGCAACTCTAG | TCTCTGAAGGTCCC | ATTAGGATAGGTGA |
| AGCACGAATTTAGT | TCTGTGAAAACTCA | TCACAGGGCTGTTC | ACTGACCGATTTAC |
| CCGTGACTTGAATA | AACCGTCTCGCTCT | AAGTATAACCCTGT | CATAGATTGATCCG |
| GGAATGATCTGATA | TGTTGCTCGCGAGG | CCACTCTCCTCTAA | CTCTTGCTCAAGCC |
| TAATCAACGGTTAC | CCTCACCTCTAGTC | GTAGCCTTTCACAC | CTGCTTCCGTAAGC |
| AGCTTGTGCTACGA | AACAGTTTATACAA | TGTCTCGCGTACAC | TAGTACACTAATAA |
| TATAAACTGCGGAT | TTGCGTAGAACATG | CGTTGACTCCGAGT | CATTTGGCTAAGCC |
| CAGGCCCATAATTT | AGTCCAGATCCCTT | TAACTGGTCGCCTA | CCGTTACTCGCTAG |
| GCATTGGAGTGCTC | ATGTATGCAACATA | AAATCGGTTATGGA | CTCGGATTGCAGAT |
| GACTGCTCCTTACA | CAACGATTGTTCAC | ATGTATACCACTCG | CTGCCTAGTGGGAT |
| GCTGTGCTGGGATC | CAACTTGAATTGCG | CTTGTAAGATGACG | CACTTTCGGGCGAT |
| TCGTGACCGCTTCG | ATCGTACCACGTGT | GCCACGTTCCGATT | CCGTTTGGTGGGCA |
| ACGCTTCATTAAAG | ATTTATGGAACCGC | CTATGCGGTAAATG | GCGGGATGATTCTG |
| AAAAGCTACTATTC | TTCGGACCTACCGT | ATTTAGGTAAGACG | CAGTCTCGTGCTAG |
| TACAGCGCATTTCG | AGTCGGTTGATACC | ATGACACTTGAACT | ACTTGTCTGAACAA |
| TAAGTTCCATAAAG | CACCGTTAACCTTA | CGTTTATGACGAGG | GACTCTCGTATCGA |
| AATTTTGGACGCCG | GTTGGCTGGGCATC | CTGTACTACAATAG | AAGATTGATTACGC |
| CCTCTCTGGATCGA | TTGATCGCACCCAT | CTATGAACTAACTC | ACCTTAATTGGCCA |

FIG. 7 (Cont.)

| | | | |
|---|---|---|---|
| CCCTTCATACCCCT | CGATAAATGCATGT | CTTGAGATGTAAGG | TATAACAAGAGTTG |
| ATGCTTACTGACCC | AGTAGTCACAATTA | ACCCCAACCTTTTC | TTAGGTGACACTCC |
| GAGTCTAGTTGCAC | ATCGGTAATGGATG | GTTCCGAGAGATTG | TTTCACGAGCGGTG |
| GGCACTCTTAGCAT | AATGCACTGGCTGT | TCCGAAATTTCGCC | CCACGGAGGTTCTT |
| AATCATTCCCAAGT | GCTCGGTTAAGCTG | ACGGTAAATAATCT | TATCCCTTGAAACC |
| TGATAGGCAGGTTC | GAGGATTTCACTCG | TGGTGAGCGCTAAT | TGGTCAAGTGGTCG |
| ATCGGCTTGCTGGG | TGATCTGGGACTAA | GTGAGACCGGTTTC | GGGGTTTGTCGCCG |
| GTCTAAGTGAAATC | TATGACTTAGAGAC | GTACTAGGGATATG | GATATCCTAAGGTG |
| ACGGTGAAAATTTG | ACAGTCGAATCTTG | GATCGTCTACCGGT | AATCGCGCTAAATT |
| ATGCCGCTTCTCAA | TATCCTACGCTGCC | ATTGAATGTGAGGG | ATACGTGAATGCGT |
| AATTCGTCGAGGGT | GCTCGGGGTCCATT | TTGCGAGCTCTCCC | GATAACCTCTAGGT |
| CTCTATCGGGCATC | ATCAATCCTGTAGG | ATTTGCTCCAAGCC | ATCCTCAGTTCGGC |
| AGTCTCGCGAGCTT | ATCGACAGTCCGTT | CGCATCTGATGATG | GTATGGAGCGTTAC |
| CCCGTTGGCAGTAT | AGGCTCGTTAATGC | TCGGGATCCTGTCA | GACTCTTCGAGGTC |
| GAACTCTCCAATTG | GAGGGTTTAGGCTC | CACTAACTCTTAGA | GATCATAGAAGTTC |
| GGTGTCAATTCCGG | GTCGCTAGACTTAC | GGTTGTGCCATCGG | ATCCACACTTCTAA |
| TAATCAGGGTTGAA | GGATGGTGCTACCT | CCGCCATATCGATT | GTTTCGTGAGAAAA |
| GTGGCGTCGACATT | ACGTCCCCATTCCT | AGACCGTTGATCTG | TGGGGATAATTCCC |
| ATTGATCTCAACGC | TTAGAAGCCTGTAA | CCCCTCCTGTATGG | TACAGTTACTAGAG |
| CGGGAGCATCGTTT | GAATTACTCATGAG | CCCTTCAGGTGACT | GCCGTTAGCCATCT |
| ATATCCGGCTCCTC | TCAGGACTTATGGG | TGACATGGCCGTGT | CGAGGGTTTATAGG |
| CTGGACCCTCACTT | GGCACTATTATAGC | GAATAGTGTTGACC | ATCCTGAGTGCTCG |
| GGGTAGTCAATGTC | TCTGCGTGCGAGGT | CCATTGATGGCCTA | AACGTTTTCGGAGA |
| TCCGTTACCCCTAA | TGTTCACTACGAAA | TGACCGTATTGCAA | TTACCTCGGGGCGT |
| GCTAGCTCCTCCTA | TATCATCACCTCAG | GCTCCCCCAGTGTT | TTGAGGAGAAGTAT |
| TTAGGTGACCGCTA | TTATGGCCACATCC | AGGCATATTGTCGA | ACTCTATAACCTGA |
| TGCGTGCGACTCGT | TCACGTCTCGGCTC | TACGAAAGATTGTC | TTATCGCTACACAA |
| GAGTCCATTATGCG | CTCTTCATAGACGC | GTCTACACATGACT | AATCATCGGGTCGT |
| CTGACGCCCTCTGT | TCATTCGTACCGAA | ACCCTTTAACGCGT | TGGAGCACGTTGCT |
| CGTAATCAGAATAT | TAATCCCTGAAATG | AGCCATCTTGTACC | TCATTAGGTAAGAG |
| ATCTAGACTCTAAA | TTGACCGGCTCTCC | GCCCATTCATATCG | GCCTGCATTCCCTG |
| TACGTTAGGATGGG | ATGTTCGGTGAAGC | CTACCATGCTGCCT | TTTTGGAGAAGACA |
| CAGTATTACCATCA | GGAGCTAATTCCAT | TGGCGGAATTGTCA | CTTTCGAGAGACCT |
| TCCCTTACTCCACG | CTCTTGTCCCAGGG | AAGTTCCTTGAAAG | TGCTAGGTATCCCC |
| TTCATACGACTCCC | GCCGCACTTTATGA | ACTTCGCTACACTC | ATCGTCCGTTCCCG |
| CCTGGCGAGTTACT | GGAAGTTGCACGTT | CTGTTCATGAGCAA | ATCGCTCCCGTACT |
| AATGAACTGGTCTG | TTACAGAGTAACTC | GCCTACTTTAAGGC | TGTATAAGAAACGT |
| ACTTCTCCATACGA | TTGGCAAAATAATG | CTATGGCTCCACGT | GGCACGCTTGTACT |
| CTACATGATTGCCG | TGCTGGATGTCAAA | CGGCCTCAATTCCT | TAATAGTTGCGAAC |
| ATGGCTTCGGTAAC | TTCTTGGCGGGGAA | CACTGAAGCTTCCT | TCTATCATTCGAAC |
| CACCCCTTGTATCA | GGTAACAGATTTAG | CGATCTAAGTGTGG | GACTCCGTGTTACT |
| TGCACTAATAAATG | ACCCGCTTATCCGT | CTGTCAATGGGCTC | CTAGTAATGGTATC |
| GTCTGTCGTACCCG | CCCATTCAATGATC | GCCTCGTTCCTGGG | ACGGTCTATTCGTC |

FIG. 7 (Cont.)

ACTCGGGTTGTCCT
GGCCGTCAGTTATT
GGTCATTATTACGC
ACGTCGGTATGCTT
GATTGTACATAGTA
TGCTGTCGGAATGT
CCGGGTTCTAGTTC
ATACGATTTCATAC
TGGCTATTCAAGAT
GGACGTGTGTATTC
TATGCGGTAAGTTC
CACGGCGTGTCTTT
ATATATTCCAAGTA
TTCTTAATCCCCGC
GCATGGCTTGTTCG
AGGCACACTTTTTC
GCTCTAACTGTTGC
GATAGGCCCTTCTT
TGATTTGGGGATCG
GATTCAATAGATTA
TTGCAGCGACTGTT
TATGCTGGATATCG
CTACATAATTAGAT
GCTGTCTCATAGCT
CCGACTTACACTTT
TCACTGATCAGTTA
GTTTGAGCGTTACA
AACCTATGGGTTGT
AGATGGCATTTTAA
TATCATGCATACAT
TTAGATATACGTAA
TGCAAGGCTGTTTG
AGCTGGTGTTTGCG
ACTCTATATCAATG
AACTTCCCTTTCCC
GCGCACCTTTCTTA
GTTGACTTGCCTCG
TGACTTGCTAATGA
GCCATTGGATTAAT
TTTACCCTGTGGAG
TCATGTAGTATACG
ACATACTCACTATT
AATCCGGGTTGTTA

TGTCCTACCTATCG
TCTCGTATAGGACT
TTCGCAGGAATTGT
GGTAGATCGTATAT
TTCAATTCAGCCGT
GACTTGTATTCCGA
TCTGTAGGGGTGGT
CACGTATCACTTTG
ATACATAACCTATT
ACCAAGGATATTTT
TTTCAGGTAGATGG
TAGTGTATGCCGGT
CAGGAGTCGGTTTT
TTAAATGCCTGCTC
TTAAATCCAGATTG
TCTTCAATAACGAT
TATAATGGTCAAGT
ACCGTCGGTATTTC
AGAGTACTGTATTA
GACTATGGTCCTAT
TAAATTCACAGTTG
AATTATGCCGCTTA
CAAGCATTGCTCTT
TGGTGGAGTGTCTC
GTCCGGTCAGCTTT
TAGTGACATCGATT
AGATTAGGCTAATT
CTCTTCTGTCCAAA
GGTGTATGTTAGCC
CCTCGAATTTGCTA
CCATTTATGGGTCC
GACGATTTCCTTAA
TGTACCCTAGTTAG
GCTTACCGATGTCT
CATTCATGGTGACT
GAAATGTGGATGTT
TCTAAGTCATCCTG
TGTATATGAACTCA
ACTTCCGGTTCCAT
TTCACTGATATCAC
GTTGTGAGTGCCTA
GTAAGCATTGAGTT
AAGTTATGGATTAA

CAATTCCATTATGC
TCATACTGCTTGGG
GTTTAGTTCCCGAA
TTCGGTGGTAAATC
TCCTCCGCTCTGTG
TGGCGTCTGTCGCT
TACTAGGTTCAATA
GTATTAGGGAGTCT
CGAATTTTAAAGAT
ATCCCTTGTAATCG
CTGTGGCATTAGCT
TTATGGTAATGGAC
TCAGTGTTCCCCCT
TAATCGTGGGTATG
ATTATTCGTCACAA
TATCGTAGCTGCCT
TCCGATACTCTCCT
CAGAACTTTAGTGT
GCGGCAATTTAATT
ACCGCCATGTTTTG
GCTTGTGAATCATC
TTTGTTACCGGAGC
GTATTCGACTAGTC
TTGTAAAACATGTG
GTGGACTTCTCATC
GTCCGTGGTGTCCT
TCTCCGCTTTCCCC
TTTTAGCGCGACTC
TGTGCGATCAATCT
TCTGCTCATATAAA
GTTAGTATCCCTGA
GATTAATTGGAGCT
TACACTCTAATCTC
TTCGGGATGGTTCC
TAGACAACTTTATC
TGACTATCATACTA
GTAATGCCTGTCTC
CTTTAGTTGGGCAA
TAATGCGTATATAA
GATGCCAATATGTT
AGTATTCATGCCTC
CCTTCTCGCCTGTC
ATATGAGTGGTAGT

CGAGTGCTCTCCTT
GTGGATTCACATGT
TTACTGTGGCTAGA
ATTTAAAGTCAGTC
CATCATCTTCATCG
TATAGAAGTGCATT
TCTGGAGTCTCGTC
TATCCACGGTGTGT
TATGTCCGGCTCAT
AGTTTATAAGGACT
CGAGTGTTTCGATA
TGTTACTCAATAAC
ACAGTTTCCATCTA
GTACAATGCCCTTT
TAAGTAGATCTATG
CCTAATTTTGGGGC
CTCATATGCGTAGT
GCTTGCGTCTGTGG
AATGACATTACTTC
CGTGAATATCCGTT
CGTTAGCGACTTTG
TCTATTGTGCAGCA
GATAAGAGGTTATT
CGCTTCTACATAGT
AGGGTCCTTAGTAT
TACTGTAACGTAGT
CATGTTGAGATGGT
ACACATTTATTGCC
TCTGGGCCTTGCTC
GCAATATTTCTAGG
ACTAGTCTGATTCC
CCAATGAAGTATTT
GCGAAATATTTCGT
TATTATCCAACTGC
TCTTTTAGCACCCC
TTTTAAGGATAGGC
CGTAACGCTGTGTT
CTAAACATTTCATC
GAAGTTCTACTATA
GCTGGTATGTTCGG
TCGGATACGATTTG
CTAAAGTTGTCTAC
TCCCATTCTGAAAT

FIG. 7 (Cont.)

| | | | |
|---|---|---|---|
| TGTAAATGCAAATT | CACCTACTTTACTG | TGCACTTTATGGCG | ATAGCTTGATGGAT |
| TCCGATTACAATTG | AATTACTCTTAGGC | ACTATCATATGTGG | GTATCAATGGTTGG |
| TGGCCGTTTTCGAG | TGCTACTTGACCTG | CTTCCTTAGCACTA | CAAGTCTCTTGGTA |
| ATCAACTTCTGGGT | TGCTATGCTATGCC | TCAATTATCTACCC | GTTGATAGTTAAGA |
| TCAGCGGTTGTCAT | TAACGCTTAACATT | AGTCAATAAAGTTT | GTTTAACATCCCTG |
| TATTTCATGCAGAC | TAGGGTATATATGC | TGTAACCCGTATTA | GGTCGAGACTGTTT |
| GCCTTTTCCCGAAT | ATGACTTTAGGTGG | AAGTCTACGATTTC | TTGCGCGTATGGTG |
| TAGTTGGCTGATGA | GTCGCTTAAGGTGT | GCGTCCTCCTATCT | TTGCTGATCGAATA |
| CGGTACGTTCTCCT | TCAGACCTATTTGG | GGCAGGTTATGTGT | GGGTCTTTGAGAAT |
| GGGTTTAACGATAT | CTTTAAGCTGAAAT | GAGTATCATTATCC | ATGGAGGTATATTA |
| TAAATTACATGGAT | GTCTCTTGAGTCCG | TTTAGCCAGACGTT | AATTGCCTTATAAA |
| CGTTTGGATGGCTA | TGCCGCTTGCATCT | CGCACTTTTTAAGA | TCATGAGACTCTGT |
| AGGATGTATTATGG | AATTCTATTCACAG | TTAACTGGTGCGTC | TTAATGACTGGGCT |
| TGTATAGCGGAGTT | GTTCGGACTATGTG | CATTACTGTAATGG | ATTATGGCCTGCCT |
| ATCATTGTCCGACT | TCCTTTAAATCAAG | AATATCTGGCTATC | CTAACTTCCATATG |
| ATCTGGTAGTTCAG | ATCTAGGATTCCTA | CTTCTAGTGGCTGG | CTGCTGTATGAACT |
| GGATAGTACGTTTG | TGGACCTTTTGAGG | CATGTCATGCCGTT | TACGTCTGCGCTGT |
| CTTGCTAGCTGGTA | TGCATTCGTATCCG | CGGTTGGGTTTCCA | CTTGAGCGTTTGGC |
| GGATGTCTTTGGCA | TATGCCTGTACTAC | GGTGGCCAATTTAT | TAGATTAGTCGTAA |
| GATATAAAAGTGTT | CTGTGAATACTATG | TATCGGTCGCGTCT | GTCGAATGGATCTT |
| TTGAGACGTTCTCA | AGTAATCATTTGAA | GTCATGTCATGATC | GTGGCAGATTTGCT |
| TAGAAGAGTGTTGT | GGCTCTCGTTACTG | CTGCGAGTGCTTAT | CCTCTTAGAATCAT |
| TTGTTAACGTGGCG | TATCCCTCCTCTCA | TACATAGTCTCATA | TTCTGTACCGAGTC |
| CTGAGTAGTGTAGT | TGTGTCCGCGTAGT | GGACTCGTCTCTAT | GTGGGTTTGAAGGT |
| TCCCGATAGTTCTA | CATCTCACGTTGTG | GGGGTACTGTTCAT | TCGTTACAGTCTGG |
| ATTCGAGTAAGTGT | TTACGAAATTTCCA | CTCTGTGCCCATTG | GACTGAGTGCTGTT |
| ATTTACCATAAGTG | AGTTAGGAGGTATT | ACGTTTGATATGAG | TCAATACCTATACT |
| GGCTCAGATTCTTA | GTCTTCCCTAAAAT | CATACTATATACTA | TGTTTGGGGAGGTC |
| GGTACTGGTTAGAT | TCGTTGCCACGTCT | TTTGGCAGTTCACA | CACTAACGTTGGTT |
| ACAGGAGTTATTCT | TCTCTGCCCTGGTA | ATCGTGTTCGACAT | TCCTACCTCATATC |
| AGTATACGATTACT | CTTTACCAAATTGA | AACGTGTCTCGTTC | TTGGTCGGTGCACT |
| TACTTCCAATCGTC | ATCGTTTCCCCCTC | GGACGTATTGTATA | TTTAGGTCTGGAAG |
| CTTATACTGTCAAA | GGACTATTAAGTAT | CAATAGTATTAGTA | ACTGTCAGTTGAAT |
| GTTAATGTCACCTC | CTAACCGTCGTATT | TGGTACCTTGGCTA | GGCTATCCTCTAAT |
| TTTCGGTCAATCCC | CGATAGTTAGTGTA | TACGATTTTACGAG | CAACGTTCTCTGTG |
| GCTCCCTTTCGAGT | CTCCCGTTAAATTC | TTTCACTACACGAT | GCTGGTAACAATTT |
| TAGTACTCCCCATT | TTAACCTCCGATTA | AGATTCGCGTTCTC | TTACATATCAGCAT |
| CTGGTTAACCTAGT | CCTAACTGTTTGAC | GTATTTGAGTCACG | CAAATTTCCTATGC |
| AGCCTTGCGCTTTG | ATTGCGTACCTGTA | CAGTTATTATCGAC | GTATAGTTTAACCC |
| TCCTTAGACATTGG | CCTCTGTGTGATCG | ATTCGGTCGACTTA | AATTCCCGTGATTC |
| TTGCTGTCCGGTAA | CTCCCATTGTGATC | GCCTTTCCTGGCGT | TTGACTTAGATAGC |
| CTATCAGATTATCG | TGCCACTTAGTAGT | GTATCATCAGATCT | GACTCACTTTCGTG |
| TGGATCCCGGTTAT | AAATCAATTTGCTG | TATCGTTAGAAAAT | CTATGCGACTTTAG |

FIG. 7 (Cont.)

| | | | |
|---|---|---|---|
| GTGTCTACACTATC | GCGGCTTTCTTGCC | TCGCTTCTGCAACT | AGTAGTCGCTGTGT |
| ATTTAGATACCTGG | TCTCCGTTGAGCGT | TTTATACAGCTAGG | TAGTAATGACTGTG |
| TAATTCTTCGGAGC | ACTTGCCTAGTGGT | TGCAAATTAGATTG | ACGCTCTTTCTCGG |
| ATTTCTCGCGAAAT | TCTCAAGTACTGGT | GCCTCTATATTCCA | TCGGCGTCTTGGTA |
| TACAGATGGTTCAT | AATCAGTTCGTATC | AAGTTCATCCTCTC | TTTAGGAATCGATC |
| TGAAACAGTTTAGT | TTACAAGTGTTCAA | TTGCCAACCTTTGG | ACGCTCATTCGTTC |
| GGCCTTTCCATGAT | TTTCCCGATGTCGA | GTTTTCCGGACCTG | TTAGTTCGATACCC |
| TGTATACAGGTCTA | TCCTCGCAACATTT | TGAAAAATTGTCTC | AATCGATGTATTAC |
| TCTTCTCGTCCACG | AACATGTTACTAGT | AGTACATCATTATG | TTAGATACACTAGT |
| ATTTTTCACAACCG | TTAGTGGAATTAAA | CGTTATCAGGTGGT | TACTCGGGATTCTA |
| GGGTGATATTGCTC | GTATTACTTGCCCA | TGGTTCATAGTACG | TCATCTGCGTGCAT |
| TTGCGAGGTTGACT | TCTATCTGCCAGAT | CGGGGTTTCTACAT | CTGTTAGCCGTTCG |
| TGTAGAGTTACAGT | ACCGATTGGTGTCT | TACCAAGGTTTAAT | GTATCTGTTAAGAC |
| CTTTGAGAGCATCT | TTACATCCGTATAA | CCATTACGTCCTTA | TACTGAAATTGGCT |
| CATATGGTAATGTC | TTTGTGCCCGATGG | CTGAATGTTAAATA | TTTCACCACCATCT |
| ATCGTTTGGAAGCT | GTAATTCGTCAGCT | TTGAATTATGCCCA | ACCTCGGTTGCGTT |
| GGGTTATCATTCGA | CGGCTCTGCCTGTT | TTTAGGCTGCACCT | TCCGAAGTTGGTAT |
| TGCTATGGGTCCAT | ATGGTGTGAGTATC | TGGTAACCCTGTTA | TAATGCCGTGCTTG |
| TGGGGAAATCTTAT | GGTTCTCATCCATC | ATCTCTATGAGTGC | TCCCACCATGGTTT |
| GTTCAATAGGTAAT | ATCGACTACGTTTA | CCTTCTTGATCGAG | ATCTGCTTCACAGT |
| ATAAATTCTGGACT | AGATCTTATGGTGC | GCAGAATATTATTC | GCTTAATGAAATTC |
| GATTCTGCCCTCCT | TTACTCAGCCGGTT | TGGCAGGGATTTCT | GGCTATATGTTCAG |
| GTCCAATCTATTAA | GCAGTATCAATTTC | GCTCCTGTGTCCTA | ATTGTAATTGAGCC |
| ATTCAGTTTACCGC | GTGTAATTCCAGTC | ATTCCTGATGGCCT | TTCTCCGTTGCCGC |
| CGAAATCTATGTTA | AGTCGATCTTTCAA | ACCCCTTATTGAAT | ATTGTCCCGTAGGT |
| TCGTCTGGGAGTCT | TAACCCTAGTCTAT | TAGACACGTTTTGG | ATGGTACGTTTCGA |
| TCGACCTTAGCGTT | TGTATACGTTCGGC | GTAATGATACTTCA | CTTGGTTGGCTCCG |
| CAAAGTATGTTTCA | GCATACTAGTCATT | CTTACGTCCTGTCA | CCGAGGTGTGCTTT |
| GTTGAATCCGTATG | GTCTTACCACCTTC | GCCTGTGGTGATTA | TACTAATCCGGTTC |
| GGCGTATATCCTTG | CTTCGACGTAGTTG | TGTCATATTGCCAG | TGACGTACTGGTCT |
| ACCTTTGCCTATCA | CTCGCCCATTTTCA | TGTTCTATCCAAGC | TTTCGAACCCTGAT |
| TTAATACGCGTCTG | TACTATCTCCCCAT | TCCCCTTATCTACA | CTTCTGCATCATCA |
| TACCGCCTGTGGTT | CTCCCCGTTATGCT | CTTCTAGGAGGTTC | GTTTTTGCCAGCCC |
| TGTCATTGAATAGG | TTTCGACGCTCGGT | ATTCGCGGTGGGTT | CGAGTTCCTTATCA |
| TCGAACTTGCTACT | CATTATAATAGCAT | TACATGTGGCCTTA | TAAGAATTTTGCGA |
| AGTATGCTTATACG | AATGGGTGTGATTG | TGACGTCCCTCTTC | CAATATATTGAGTG |
| TACCATCTCGTCTA | TCAGCTATCATAAT | GTAACCTTAACCTT | ATTGATTCGGACTG |
| ACATTGTTAGTGAG | GCGATGTTAATCTC | ACTGATGTTTCAAC | ACCACTAGATTTCT |
| CTCGCCGAATTATT | TGTCCAGTCTGGTA | CATTTTCAGGAGTC | ACTTTACAAACTCT |
| GGTTTACATGATCG | GGCTATTGATCTAG | ATGGTACGCATTTC | ACTTGACATGATGT |
| TTAAGGAGCTCCTT | ACTAACTATTGTGA | CTCGATGTGCTTCA | GTGATCTTTGCCGG |
| TAATGCCGTTGCCT | TCGGATAAATTACT | CCTCTTTACGCCTC | TGCGCGTTTGGAAT |
| AATCTGATGAGTCT | TAAGCTTCTCGGCT | GTTGTGCCTACTCG | AGTGCCTAGTGTAT |

FIG. 7 (Cont.)

| | | | |
|---|---|---|---|
| CATTTTCTAAGACA | TGATCCGATTCGTC | GTACTCGTATATCG | TCCTTCTCATGACG |
| ACCTGCGCAATTTT | TTTGGCGTTGAGCA | GAATATCTAGTTAG | CCTTACCTCTTCCG |
| CCCGCTAGTTTTAG | GGGTTCCGATTAAT | GGGCACTCGTTGTT | GCTGTCCTGTGTAA |
| GTACTGCACTTATC | TTCAGCTTTAAGCC | GTTTATTGGAGGGG | GATCTCGTATGGAT |
| TCCGAGTTCTTGCG | ATTTGGAGCTAACT | ACCTGTTGACGTTG | TGGTTTGTACGCAG |
| TGCGTAGTACGTTC | GGGCTTTCCTCTAG | CCTGATTAGTTCAC | ATTGGTCGTCCATG |
| CATTGTCGGATATG | TTCGTACTCACTCG | AGCTCTCTCTAAGT | TATACATTCCTACC |
| GGCTTCCTGAATTC | GATTAGTTTAGAAG | CTGGTTCAATGAAT | ATTCGGTTCGTGCA |
| ACACGTTTGTCACT | TGCTCGGTTATCAG | CTACGTCTATGTGC | TGAGCTGTGGTATC |
| GTGCTACTCCGTCT | TACGACCATTTCGT | CTCTGGGTTAGCTA | ACAGTTTAGCCCTT |
| AAATTTTGGGGATA | TGGGATCATATGTC | TCGATAGATTCCCT | CAATTGTACATCCT |
| TATACTAAGGATAT | CTTATGCTGAAGGT | CTATCGTTCAGTGC | ATAACGGCTCTGTT |
| ATCCGTGTATGATA | TGTGACCTTACGCT | GGATTGATGATAAT | CTTTCCTACGTCAG |
| CTCAAATTATCACT | GTTGTTTAGAACAC | TACTGGAGATATCT | TCTAGTCCTGTACA |
| AATGTTGCATCTGA | CAAGACTTTATCTC | TTAGACCAATAGTT | TTGCGGGTGCGTTA |
| AGAAAGTTTTACTA | CTTTGGCTCCCTCA | TTGTTAGCTCAGGC | AGTTTGACTCTAGC |
| GCTTTTGAAGGAAT | TTTATATGGCAGCG | CTTTAATATCACAC | TTACATCAATCCCT |
| GCTTTCAGCTACTA | TGGTCCCTTGATGC | TCAGCTCGTACTTA | CGGTTAGATTGTAG |
| GCTTTACTCTACAC | ATAGTCTGGTGTCA | GGTCTTGCGTAATA | GGGTAGCTTCATTA |
| TTAAGCTACATAGT | GCCACCTATTTTAG | ACAGGGATATTTTC | GGATACGTATTTGC |
| GATTTGGCGGTGCT | ACTCTGCATTGCAT | TTGATGCGTAGTGG | CCATTGGCGTCTAT |
| AAGTTGCCTGGATT | CCTCTGATTCATGC | GCTTTAACAGTCTA | CCGATTGAGTCTTG |
| CACATTATTTGACA | ATGGTGTCTTGCCC | GGCTATACCTCCTT | TTGGAGTAGATCTA |
| TGTACCCGTCTATA | CAGATTTTAGGCAT | CATTGTCCTCCGTC | ATTTGGACTTACGC |
| TTGTCACGTAACAT | CATTTCGTAATCCG | CCTTACGTGCTTAG | TGTCTTAGATAGCC |
| GAGATGAATTGTTC | CCTCGCTTATCATG | GCTTTAAATTCCCC | TTCTGACTACAGGT |
| GATTCCTTGTAAAA | TCAATTTGCAATGG | CCTATGTCTTGACG | CAATTCATGACTTC |
| TCAGACTGTTGATC | TGTATGTAGTACCC | GCTTTTGGGCCCTC | CACTTTGGTAACTG |
| GCGTTCATTTAGAC | CTACGTAACACTTT | GTGAGCTGTATCTA | TTATAGCTGAGACT |
| ATATTCATCGCATA | GGCTCGTTTGGTCC | TATGGATGTATGCA | AAGGATCTTTGCTG |
| CTCTGACTTTACGA | TGTTTTCAAAAGGC | GATCTTCCCGTGTA | GTTTTGACATACAG |
| GCTAGTATGACCTT | ATCCTTGTAGTAAG | CGTTCTATGGTCGC | TACTGTTGTGAGCG |
| TAGTGCACTTACTC | CAATGCTGTCCGTT | TGTTGGTTGCGGCC | TCAGGTTCTACTGG |
| CTTTACCATCTGCC | CTCGCTCTGTAAAT | AGTGTAGAGTTCGT | TACTGTGCGGGTTG |
| TGTCGCTAATGAAT | GTGGTTTGGCCCGT | TTCAGAAGTAACTT | CAGCGTTTTTGCCC |
| GAGCTGAGTTTTGA | TTTCGCTGCTACCC | ACGGGTTTGTACTC | CTCTTCTCAAATAA |
| TTAGCATTCATAGG | CCCTTGGTTAGGGT | TGAGGTTCTCTAAC | CGTGCTGAGTTTCA |
| AATGGTCCTTTACG | TTCATAGGATAATC | CTCCTCCGGGTCTT | TCCTTTCCCGTAAG |
| TATGTAATGAACTC | TAACTTGTTACCAC | ATTTTCAGGTAAGG | GTATGGTGATTCGG |
| GTGGGTAGTCATTG | TGCTGTAACTGTAA | CCCCCTATATCCTT | GTAACGTTTTAAGC |
| CGTATGTCGTCCGT | CAACCCTCTGTTGT | TGCGTGTGCGATTC | GAGTTTAGATATCA |
| GTACTGGTGTGCAT | CCTCGATGTTCGCT | TAATGCGTCTGCTC | GAATTTTTGGCAAG |
| TGACCCTTGTAGTG | TCCGTTTACCAGGT | CCTATCCCATATGT | TTGGAAGTTCGTGG |

FIG. 7 (Cont.)

| | | | |
|---|---|---|---|
| GATTCTCACGTTGG | GGGTCTTCTCGCTA | TCACCATTATCGTA | TGAGTCACTTAAAT |
| AGCTTTGTTAGCAA | GTGTTCACTGGGAT | TAGGAAGTTGATTA | TCAGCCGTTCCTGT |
| GCCTACTATATATG | CGTCGGATTCTATG | TTGGCAGGTTACTA | CTCGAGTACTTGGT |
| AATTTTGGCATCGA | TTAGCTTCCCAGTG | ATTCATTGCTGGGC | TCATGTAGTCAGTC |
| ACATTGGTTACTAC | ATAAGATGTGCGTT | TCGGATCGTTATGA | CTTACGGTTAATGG |
| AACAATGCTGTTCT | GCGTGTTGCATATC | TTATGCGCTAACGT | CGTTGATTACGTAC |
| TGGGTTAGAATGTA | ACGCTTGGTGCCTT | TGTGTTGAACGCGT | GTCAGGCCTAGTTT |
| TGCCCGATGTTATC | CAGTAATTGTTACG | AGGCTTATCTGCTG | AAGCGCTTAGGTTT |
| ATTCATAGGGTTAC | CGAGAAATTTGCTT | CGTTCCCTAGTGTC | TGGCTGAATGTTGG |
| CTTCATCTTGACGA | TTATAGCGTTCAAG | TGTGGTTATACCAC | CGGTAATTGGATTC |
| ACTATATGGAGGTT | GCTTAAATGCTTCA | GCCCTCTCATCTTC | GTACCAATTTTACC |
| ATAGGTAATGTTCA | TGATTACTGAGGTA | CTGTTAAATAGTGC | CTGTGGATCTCAAT |
| CTACGTGGGTATGT | GCAATATTGCCGTT | CGTCGTAGTTAGTA | ACATTTGCCTCGTG |
| CTTCGGTCACTATA | TTCGGTAGGTTGAC | TGTTGACTACCCTG | AGACTCTGTTGCTA |
| TGTAGCCCTTTAAG | TCCCCTGGGTTCCT | CCTAGCTTCTCTCC | GTGTTAGCTTACCA |
| GAATTTGCGCGTTC | TTCGAAATATAGAT | CAATTTGATTCGAC | TATTTGCCATGCGA |
| AGGTGTTTAGCAAT | CGTATATTGATAAC | TGTGTGTATGAGAA | GCTTCATTAGGTGC |
| CGTTGCTGATTCAC | ACTACCCGGTTTTA | ATCTGTCCTGCCTA | TAGATCAGGGTTTA |
| CATCTTTATGCGCG | TCTTAACTTCGAGC | TAGAGGTTTGTCAC | AGATTTAACTGTCC |
| TAAATTGGTGTGCG | GGCTTGATTAATCA | ATATGCGGGTTTCC | CGATCTGTTGGATG |
| CTCCTGAACTATTC | AAGGGTCCACTTTT | CAATATTGCAATAT | TAAATGGCCCTATT |
| AATCGACTCTCTTC | GTAATAATGTAGTC | GACACTTACTTTCA | TTATCTCGGCACTG |
| TTCAATTTGCAACC | AATTTGTCAGATCG | CATCTTACCATTGC | CAATCCTATGATTG |
| ATATTAGCTCTGCG | TTTTAAGGTGGCCG | GAGTTTGAATTCAG | ATCAAGATAGTTTG |
| GACTTAAGGTTCTA | TTTTCGCACGTGAC | TTCAGATCGTCGTA | ATTTGATTCGAAAA |
| CCTCTTTACATAAA | GGAGTTATAGTTGA | AGCGCCTTCTGTTC | CGAGGTTGTCTTCA |
| GTAACACATTTATG | TTTACAAGTATCCA | ACGGTCTTGACTGT | TATCAGGATCGATT |
| TGATTAATGATCCG | CGGTTCCAACTCTT | GGAAGTCTCGTTGT | TCTAGATGGCATGT |
| CTCTACTGGTGGTG | AGGTGTCTCATATA | CTGATAGGTTCATA | TAAAATGGGTTCTG |
| ATTTTGTGCGGGCG | TACACTCTATGAAT | CATCGTATTGTAGC | GAGATTGAATGTCT |
| CCGGAGATTTCGTT | GGGCCATTAATTTC | ACTGCCTTCGGTGT | TGCTGATTCTCACG |
| CTCTTTTGACAAGC | GTTTCCATACTCAC | CCATTAAGTTATAC | GGATCCATATTGAT |
| TAATTGGATGACAT | GTTGATCTACAACT | GTGTTCGGCCTCTG | TTGTACTCGCTAGC |
| AGTTTCCACGTTCA | GACGAATGTTCTTA | TTGCTGTTACGCGG | TCATTCCCTGTCCG |
| CGTGTTGTGTCAGA | TCCTACCTTAATCG | GTTTCGTGTACAGC | TTCAGGGCTTGGTG |
| AGTAGTTTTGGGAA | TAGGGTGATTACCT | GTTCGCTCCCTACT | CTGATTCATGCGCT |
| TTATGAGGGTCGTG | ATGGAATGGTATTG | AACATGTTAGATTC | GACGCTATTGGCTT |
| TGCGAGATCTTTGC | CCATTTACCTCCGT | CTCACCATTATATG | GTGCTTATCGTACC |
| TAACCTTTCGATCG | TATGCTATTGGAAG | TTGGATTCTAAACG | ATAATGTATGGATG |
| ACTCTGAGATTATA | CGTGGTTGGACCTT | TGAATTGAGTCGGT | CACTCTAAGTTTAA |
| TTCGCCTCCGGCTT | ATACTCTAAAGGTT | CACTCTCTTGAGGT | CAATTTAGTATCAC |
| CCGGTGTTACATTC | ACTATGGGGGTCTT | TCGTTCTATGCGGG | GTCTTCGTAGCCTA |
| TCGGATCATTCGAT | GATTACTCCGTAGT | GCTTCCATTCACCT | CACATTGTCTTAAG |

FIG. 7 (Cont.)

| | | | |
|---|---|---|---|
| GATTCATCTATGGC | AGTGTCTCGCTAAT | TGTTACTCGCCCAT | CAATTATCGTCTTA |
| ATTTCCTCGCCATA | ATGCTTATAGATGA | TGATCATATGGCCT | CTTAAGTCTCTTCC |
| ACGTCTACGTTAAT | GGTTGCGCAGCTTT | AGTTCGTCCTACAT | ATTCTACCGATTGT |
| AGTAAGGTTATCTC | CCAATGTTCAATCT | GTAGAAGTTTATAG | TAGTTGCTTCTCAG |
| CCTTCTATAATGCC | GAAGACTTTTCCAT | TTGGTACTAGAAAT | TATCTCCCTCTTCA |
| GCTCCCGAATCTTT | TGTGTACGGGCTTG | TAGTTCATAATGGC | TTTCCTCTAGACAT |
| TTGTTTCCAAAACC | ACCTATTAGTCTAA | TAGCTGATCTGTCC | TTATGCTATCGTCG |
| TTGAATTGCACGGT | AACTCATCTTTCGA | CAGTGTCGGCCTTT | CCGTATTTCCGTAT |
| GTCTTGGTTCAGAG | TATGTATCCTGGGC | TCTTGGGCACGGTT | GGATTTTTCCTCAG |
| TAACGTGGCTTGTC | AGAGCTTAGAATTT | AGACTTGCTTACTG | GTTGGTCGATCTCT |
| TCCTTGTCTGCGCC | TTAGTAGCTATAGC | GGTATGAAAACTTT | TCTCTCCGTCCTGT |
| ATTGCTGTATGGGA | AGTCGGTTCAATGT | GTCTTGACCGTAAT | ATTCAGCCTTTAAT |
| TTGGATTCAACTAA | CGCCCTATGTTTCG | AATCTTGATGACTA | CTCATTATTCTGGC |
| CCTTTCATACTGGG | GTTACGAAAGTTAT | ATCGCAGTTTATCC | ATACTTCTCACGTT |
| CGAGGCTCTATGTT | CTGCTTGTATCGCA | CCATATTGAATTCG | TTTGCTACGTCACT |
| GTCTACTTTGAACG | ATCGAGAGCTTTCT | TGCTTATACATCAA | CTTTCTCTGACTCG |
| GCAAATATGTGTTC | TTGATCGTCACATG | CATGTGACTTTCAG | GTTTTATACGGTAA |
| GAGTCTAATTTAGA | TCAATGTCTCAATG | ATTGAGAAGTCATT | GTTAGATGTGTTGA |
| TCGGTTTGACATAA | GTTGATGTGTGGCG | AATCCGGATTTGCT | TGAGTGATTTAGTG |
| CGTCTTGCTGGTAG | ATAGCTTCTTACAG | TCTGTCCTGACGTG | TTTACTGAACTTGC |
| TTGATTATAGCCCG | TCTAATCTGTAAAA | ATGTGCAATTGAGT | TAATGGTTGCTTGA |
| TAATCTCACGATTC | TGGGGGTCTATTCA | AAGATGTGCCGTTT | TCGGTATTGGCTTC |
| CTCTGTCCGTGTGG | TGCCTGGTATCTAG | AGAGTTGCTTCTAC | TGCATTAATACTCT |
| ACTCCATTCGATTC | CATCTAGTATGTGA | ATGCTTATATCCAC | TTCTATCTGTCGGA |
| TTGCACGTGATTGA | TGCTATGTAATAGA | ATCATACTAGTATC | GGTATTATGGGTCT |
| CTTCACTATCGAAT | CACTAAGTCATTAT | GGTTCTGAGGTTAC | CTTTCGTGTCTCAA |
| GGCTACATAGTTCT | TTCAACGCTACCTT | GTGTAATTCGCCAT | TTGCTCCGTTGGTA |
| GGTTTTGTGGCACC | CCTATTAAGTGTAC | CGTTCAGAGGCTTT | GATGATGTTAGGTT |
| TTGTGTATAAGAGC | ATGGGTCTCCTTAC | TCGTACTATAAAGT | CTTCATGCGCCTTT |
| CGTGCTAGATTGAT | TTGCACACGCTTCT | TTTGCATCCTAGAA | CTGTATTCCTTGCC |
| CTCGATTCCTGTCG | TGGTGCTAAATCTA | CGGTTTACGTTAGA | TGTAGTAAATCATT |
| TTATCAACCGTCCT | ACTTGCACTGATTG | TCCGTAAGATTCAT | ACTGGGTTATCTCT |
| CTCCTGTGCTAGAT | GGTTTTGAATACGA | GCGATACTTTCTCC | GTCCGCTGGTTTTA |
| CTTGCGTATTAAAA | TTGGCTATCGCCAT | CAAACTTGGTTTAC | ATGATTTGCTACAT |
| CTGTCACTTGTAAG | TGTTAGATAAGAAT | TGTTGCAGATTGCA | TCTTCCCCTTAGAT |
| CATGCGTATGATGT | TAATCACTGATGCT | CGGTTTGATCTCGC | TATTCGTCTGCGAT |
| TTCAGCGCTTCTGA | TGTTTACGAAAATA | AACTCGTAGGATTT | TTCGGTATTCCACT |
| TTTCACCGGGTATA | TGGTAATAAGTCGT | AATTGCTCTAGGTG | CTAGGTTTTACAAT |
| TCAACCTGGTTTCG | TGTAGATGTCTACG | TCATCATTTGGAAG | AGATTTCGTTCATC |
| TGGGGCTCCTAATT | TTGCTACTTAAGCC | TTGCGCTTATCCCA | CCTCATGTTTGATG |
| ATCTATGTGAGAAT | CGACTTCCTTTCAC | AATGTATTCTGAAG | CATGGTTTGTAACT |
| GATGTTTCTCGCGC | TAGCCTTTATCGCC | ACAATTCTTCTTGC | GCTACTTTACTCTG |
| ACACCTTTGTGTGC | ACTAAGCTTTGTCG | AGCTGAATATTTTA | TGCACTTCCCTATT |

FIG. 7 (Cont.)

| | | | |
|---|---|---|---|
| GCTGGCTTTGTGTG | TTCAATGGCCATTT | CTATGTTTCTCCAG | ACCTTATCATGCTT |
| TTAATCTTAGGTAC | TTCTTACCCTTACC | GCCTTTCTCTCTAA | TGTTCTATTGGGCA |
| TTGAAGTCTTTAGG | GTTATTCTAATGGC | TCTCTTTCGACTAA | ACGCTTACTTTGTG |
| GTGATCGGAATTTT | TTCTTTCACCGTGG | GATTTATCGCTCTG | GGTGCTGTCGTTTA |
| TAGCATGTTTTGCA | GGTTCCTTAAGTCT | TATCTTAATGCTGC | CACTTTATAGTTCA |
| TTTCTGTGGGCCGT | CTTCAGATATGTTA | GGTACTTGGTCTTG | TGCTTTTTGGAAGA |
| TCCCGCTCTGTGTT | TTACTTAGGTCCAT | TATCTGTACAGTGT | ATTGCCTGCTTCTG |
| AGCCTTTCGTATAT | CGTCTTGTCCTATA | TAGTTTGAACTGCT | AGGAGTTCGTTATT |
| ACAATTCCTTGCTT | TGGAAGTTGTTTCA | TTAACCTTGTTCGA | ATACTTTTTCCAAG |
| TGTGGCATTTGTGG | ACTTTAGCTCGTAT | CACTGTACTTGCTT | TCGATTGTGTTAGC |
| TAATGTTCTGATGC | ACTAGAGTTTATTC | CGTGTATAATTTGG | TCTCTGGCGGTTTG |
| TCCGTCCTTGTAAT | GCAGTTGTGTGATT | ATGTAACTCTTTCC | CTTCGCATTCTTGA |
| CATTTGTGAGTTGC | GTTTTATGCCACCT | ATGGTCTGTCATGT | GTCGTTTCTTCAAC |
| TATGTGTCCGTCTC | ATGAGATTCGATTT | GTTAGGTTGATGAT | TTCCATTATTCACG |
| AGTGACATGGTTTT | TGCACACTTTATAT | TAGTTTAGTTCGGG | AATGTCGTCTATAT |
| CTGGGTCTCTTGTA | CTATGATCTGTACT | TGTGTTACAACTAT | ATTTGGTATGGGGT |
| TTGTAGAATGATTC | CGCTTAGTTGTCGT | TGTGAGGATTTATC | GTCAAGTTGTTCGT |
| TATTATATGGACTA | TTTTATTAGCGCGA | TTTCGCTAAAATTC | TCGACTTTATACAT |
| CGGTGGTATCTATT | ATCCGTTCTTCCAT | CATAAGTTGTTGTG | TGTCTGTTCCGATC |
| CTTTTTGACTAACC | TCCTGCCGATTTGT | CTTATTGGCATATC | TATACATGTGTCTG |
| ATTACGCTGGTGTT | TATCGCTAGCTCTT | TCGTCTTATGGATA | GTGTGCTAACTTCT |
| TATTTCTAAGAGTG | CGATCCTTATCTTA | TAGAAGTACTCTTT | GTCCATATGCTTTG |
| TTAGTCCTGTCACT | ACTATAAATCCTTT | CTGTTTCCACATTA | TACATTGCTTGTAG |
| ACTGATTTAAGTAT | ATATGTAAGGTGTT | TTGATAGACTGTTG | CCCTTCCTTTCATG |
| CAGCTTTTGGCTTA | GGTCTGGCTCTTCT | CTAATGTTTTGGAG | ACATTTGTACAGTT |
| GGCGTTCTTTCACT | TTTGATCAGTAATG | CTAGCTATTTAATG | GCTTGTTATAACCT |
| GGTATGTTCGTGTC | TAGATTGGTATATA | GGGCTTTTTAGGTG | TTGGTATGGATGTG |
| ATTCTGTTACGTAA | CTGTTACATGTCTA | GGGTTTACTGTCTG | AATGATTTAGTGTA |
| CATGATCAATTTCT | TAATCTTACTTGGC | ATCTCTCATTCTCC | TTTTCGTAAACATG |
| CTATGTTAGTTAAC | CCCCTCTATTTATC | TGTTTACACCATGT | ATGAATTAGCTTCT |
| TCCTTGTCGTAGAT | TCGTATTGTTACAC | CTCTCTTAAGCTTC | CTACATTTGGTGCT |
| ATTGTCGTGATAGT | TCATTCGATCTCGT | CACGATGTTTATTG | ATTGTGGTGAATTC |
| TGATATTAGCACTT | AGATCTGACTTTAT | TATCTGCGTGGTAT | TCTATGAATTAGCT |
| TCGTGGATTGATAT | AGTTTGTTTGAAAC | TTTAGTATCGAATG | TTACTTTCCATCGC |
| TACTTGTTGATACG | AAGTGTGCTTCATT | TGATGATCACTCTT | ATCTGTTGCGTCTC |
| TTGATTGTGGATAA | TTCCTGTTATCAGA | TCTTGAGGTGCTTC | AGCTCGTGTGTTAT |
| AGGGTGTATTTAAT | CTTTGCCCTGTTCA | AATTTGGCAATTAT | TTTCGACGATTATG |
| CGTCGTGTTACTAT | GCTAGTGCTCTCTT | GGCTTATTCAGCTT | TAAGGTTGCTTTGG |
| TAATATCTTAGCGT | CTGCTGGTTAAGTT | GGTATGCTCTGTAT | CGCGTGTTGCTTGT |
| GGAGATCTTTTGGT | ACTGCATTTTTGAG | TTTAAGGGCTTTCA | CATATAGTTGGTAT |
| ATATCCTTCATGCT | ATGATGTTGGTTAC | CAACATGGTTGTTT | TTTCTCACCTATAA |
| CTTAGATCTTAGTG | ACACTTTATACTTA | TTTATGTAGAGAAT | TGTACTTTTAACGC |
| TTATTGTACCACTG | ATGTTTCTAAAGTG | GTGAATGTTCATCT | TTGGTCACTTTCCG |

FIG. 7 (Cont.)

| | | | |
|---|---|---|---|
| GCAGTGCCTTCTTT | TGTGTTGACATCTC | TTAAGTCCGTTTCC | TTATGGCTCTTCCG |
| ATTATCATGTCTAC | TGTTATATAGCTCC | TTTTGCCGTGCAGT | TGCTGATTTATAGC |
| CACCTGTATTTCAT | ACTTAAGTCTTTGA | ATTTCTGTCCAATA | TGGATTTTACAGTC |
| CTATGTTGAAGTTC | GCTGTCTGGATATT | TGAATTTTACGTGG | TTCTCGTCAGTTGG |
| CTGCTGTGCTTATA | CTGTTAATCAGGTT | GGTTAACTTGGATT | TAGATCGTTTGTGC |
| TTTCTGACACCTTG | AAATCTTCCTGATT | TCCATATGTTATGC | TTGCACTTTAAATC |
| TAGCGGCATTTTTG | GTAAAGTGGTGTTT | TACATATTTCTCAA | CTTTACCTGTATAA |
| CATCGGTCTTCTTC | TATCATCCTGTGAT | CTTAGGGCATATTT | TACAACGTTCGTTT |
| GTTACTAATGTGTG | CTTAGTGCCTTTAC | CCCATTGTTTCCGT | CGTTATATACTCAT |
| GATTGATCTAGTCT | AGTTCTCTATATAC | TTGTTGGCCTTCGA | TCCTTTATTGACGG |
| GTAGTTATGATTCG | GGCTAATTTTTGCA | TGTCTGCACCTCTT | TGTGGGTTCTTCAA |
| TTTTCAAGTGGATA | ATTGGCCGTCTTAT | TTACTTGTATAGAC | TGCCTCGTCATTCT |
| TCTATTTCATCAGC | TCTCCTTCTTCCGA | CCTAGAAATTTATT | TGTTACGTTTCAGA |
| GGGCTTCGTTCTGT | CTTTTCAGGCACTT | CTTGATCTATTAAG | ATCTCATACTTGTC |
| TTTGTCCTTACCGC | GTGGTTTAATTGCG | ATTTTTCGTGGGAC | TGTTAGTTCGTCCG |
| CATGTCTCTTTAGC | AGTGATTACTTCCT | CAATCCTGCTTTCT | TACCTTTATAGTCG |
| TGTGTAGTGCCTGT | CTAGTCGTGTTTAA | CTTCATTGTAGATA | ATCTGGATAATTCT |
| TACATATATGTGGT | CATACTTTATCTGC | TGGCTTCAATCTTA | CTATCGTTTTGCCA |
| GGTTCTGTCTGGGT | ATTGTATGATCAAT | ATTGGTAATTCTGG | AACCTTTTTGGCTG |
| GGAGCTTATTGTTA | GTTAATTGGACATT | CTGTTCCTTATACC | ATCTACATGTCTCT |
| TGTGCTTATAGACT | CCTTTGGATATCAT | CACTCTCTTCTTCC | CATCTTTGACATCT |
| GCTATTCTTGGTGA | TAATTCTGGCGCTT | AATTCTTTCTGCAC | GTACTTCCTAACTT |
| GATTATCGTGCCTT | TCGTTATCTCCAAT | AATTACCACTTTGT | CTATATCAATTCTA |
| ATTACTTTCTAGCG | GAATTTTTACTGCC | CTATTTCCCTGTAC | TTAGATGTTTCACA |
| ATTTCGTGGAGTTG | TTGGCCCTGATCTT | TTGTACGTGGATTG | TAGCATTGTCGTTC |
| TTCTTGGGCCTACT | TTGCCGGTCATTTC | CCCGAACTTTTATT | CCTTGTCTGCTCGT |
| CTTTGATCTTCAGC | TGACGGTTTATCCT | CTTTCCAATTAACT | TTAGCCGTTGATTC |
| AGCGATTCTTAGTT | TGGTGCACTATTGT | TTCGCTTCGTACTC | AACTTACTAATGTT |
| CATTCTCATTGTGA | GTCCTACTGTATAT | CTTGTTTGTGAAAG | AGACTTTCTTTACA |
| CTTTCTTCTGAAGA | CCGATACTTATTAT | CTCTCTCCTTCAGT | AGTTCTAAGTCTCT |
| GGCTTTCTAGTGTG | GTTTCCTGCGCTGT | GCTTCGTCGTTGTC | TGGTTTTATAGCGA |
| TATGGAAACTCTTT | TTTAACCTCCTGTA | GGATCTAAGCTTTT | CACTTCGTTCCTTA |
| TGTTAGATGTGGTA | CTTTTTCACTCGGA | TGATATAGTTGTAC | TCATCAGTTACATT |
| TTGCATTGGTCCTC | CTTTAATGATGGAT | CTTACCGTGTACTT | TGCGTTTGTAATAG |
| GCGCGTTTTATCAT | TCTAGTTAACTGTC | TCATTAAATGCTAT | GGATATTAATTCAT |
| CTAGATTGTCTGTC | ATCTTGTTTCGGGA | TGTTTGCCAGTAAT | GAGTCTCCTGTGTT |
| CTAAAGATCCTTTT | GTTAGTAATTTCAC | ATCTTTATGATGAG | AATGTATGGCCTTT |
| TCGTTCTTGAGCTC | GTTTGATAAAAGTT | ACCTCTTTCCTCAT | TGCCAAGTGCTTTT |
| TTATTCAAGTTGCA | TCCATTCAGGTATT | CTTATTTCTAGAGC | ACTCCTTTGTTCCG |
| GCCGTTTACGTTTC | GGGTCTTCTTAGGT | TGTTGGTACTAAGT | GAGTACTTTGATAT |
| TCGTTTACTCTCGA | TCCTTTGCTACAGT | TCCGTTATAGTTAG | CATCTTTCTGTCGA |
| ATCGTTTCCTTGGA | ATTAGGTTTAACTG | AAACTTGATGTTAT | TGGTTGCGGTTATA |
| TATTGCATCTCACT | CTCGATTATTCTGC | ATTCGTGAATTTCA | TTTACTTAACGGAT |

FIG. 7 (Cont.)

| | | | |
|---|---|---|---|
| TTGTGAGTCATGCT | TCTCCTCCGCTCTT | TTGCTAGTTATAAG | TTTTGGGCGAAATT |
| TGTTGATGCCTTGA | ACTTAGATTCGTTA | TTGTCCTATAATCA | TACAGTTCATATGT |
| GTAGTTTTAGCTCC | TCAGGATTTTAGAT | GGGCTCGTTTACTT | GTATAGCCTTGATT |
| ATTCATTTGAACCT | CTCTTCCTAGTGAT | TTATTGAAGCGATT | CTTTGAGCGGTCTT |
| GTCCCTCTTGTTAG | GTATTAAGATGATT | TTGGAGTATACTGT | ATTTGCTTAACTAC |
| CTTTCGTCACTGGT | GATTGTCTTCTGCG | AAGTTACTATCTTG | TTTCGCTTTCCACC |
| AGCTATTAGATTTG | GTTCTACCGTTCTC | GCTGACGTCTTTTC | AAGTATCTTGTAGT |
| TATGGCATAGATTT | CATATCTGAATCTT | TTGTGTCTAACCAT | ACAGTGCTTTTTCA |
| GTTTTGGGGGTTGG | TAGTCAATTAAGTT | GTGTTCTGATGTCG | GTTACCAGATGTTT |
| TTGTAGGTTACTAG | GATTTTGTTGCCAA | CCTTCTAAATCTTA | GTTTGCTTCAAATG |
| GTCTTGCGCGTTTA | CCCGTTATTATAGT | GTGATTTAATACTC | TTTTGCTTACCGGA |
| ACGTATGTTACTGT | GCTTTGTAACTGTG | ATGGCTAGTTGATT | TAATTCATCATCAT |
| TCCTGATATACTTG | ACATTATTTGAGGT | AAGGCTCTTTATGT | CTGTTCTGCCTTCA |
| GTTTTCTAAATGAC | GCTTTTGGCGTTCC | ATCTTTTACGGGAT | GGGTTAATTTATGG |
| AAAGTAGCTTATTT | ATGCGTCTTCTACT | CTGTGTAATTGTCG | ATTGAATTCTGGTA |
| TGTGTGAATGTACT | TTTCTGACATTAGC | TAATTAAGTACCTT | TTTCGCTACTCATA |
| TTCACTGATTGACT | TTGTGGCCTCCTTG | AAGTTTGATTCTCA | TGGTTTTATGAGCC |
| GTTTACTTTGGCGC | ATCTTCAACGTTGT | GATGTTTTCTGGCA | GTATTATCAATCAT |
| AAGGTAATCTGTTT | CTGTTCTCAATCTC | TAGTTCATCTATGA | TTCTCCACTCTAGT |
| ATGAGTAGATTTTG | CACTAGTTTACGTT | AGGTATGTTTCCTC | GTCATTGAGTTTAC |
| TTTTCAACCCTATG | TTCTGCATGCTGAT | TCTTGCTGGCGTTC | TCTGTTTGCAAGTA |
| TCCATTCGTGATAT | AGCACTCTTGTTTA | ACTTGTTATTGCGC | GCTTTTTCGCTGAA |
| TGAATCACTCTGTT | CTGGTAATTTATCA | CCTTGGCACGTTTT | AGCTTTGTTGAGTC |
| TTTGTGGAATAGTC | TTGGGGTCCATGTT | AGTTGTGATTACAT | GTATTTTAACCTGG |
| GTACGTTTTCACCT | CATATGGTCTATTA | TGTAATTGCATTAC | CTAGTTTAGTTCGG |
| TTCTCGATCCGTTC | GTAACGATTTTGTA | CCTTTTGCTAGGTG | TGGCTTCTGTTAAG |
| ATTTATGGTGGTGA | CTGTCGTTATCTCC | ACAGCTCTCTGTTT | GTGATGTCCTTACT |
| CTTAAGCTTATTAA | GTCGTTATCGCATT | GTCTTTGGTGAGGT | TTTTGATCCGAGGT |
| AGATTCTGATGTAT | CTCCTTTTGGCAAT | ACGCATATATATTT | TGAGTTTACGTTCT |
| TTTAAAGGTATGTG | CGTTTTAAATTCCC | GCGATTTTATTGGA | GCTTTTATTGAATC |
| TTGGTTCGCACTAT | ACGTTCATTAAATT | TTGCTACTTCCATA | CTAATTTTAGTCTA |
| TAGTTCTCATAAAT | ACTTGTTTACGCCT | TACGTGGTCATTTA | ATAATGTCGTTTTG |
| ATATTGTACTTCGC | CTCTATTCAATTGC | GTACTTTACATACT | TCTAATTCCGTTGT |
| CTAGCTGTCCTTTC | AGCCTTGTTATGGT | AGCATTGATTTATA | TTACGTTTTGTGGC |
| CTTTATGGCCGTTC | ATGACTCTGTGTCT | TTCGTTGGCGTATA | AGGTTTTTGCTGAT |
| TGGTCTTAACTTCA | TATCTTGAGATTCA | TGTTCATTACACCT | TGGCTTTGTCTCAT |
| CATTCTAGGGTTCT | ATACTGGCTGTTTA | CCTTTAGATTATGA | CTTCCCCGTTTTTC |
| TTTGCATCCACTTG | TTTTCGCTGGTCGG | TTTTCGATCGCTCG | GTTGCTTTTTCCCA |
| GTATGAAGTTTTCG | ATTTCGTGATATGC | ATTGAGCCCTTTTC | CCCTATTGTGTGTT |
| TTTACAGTTCATCA | TCCGTTTCTGATGA | ACATTCTTTCACTA | CATGTTCGTGTATT |
| TTTAGATTCCCAAT | CATATTGCTTTCCC | GTTGTCCTCCTGGT | CTACTCTTTAATTA |
| TTAGCTAGTTTGGA | AACTCTCTTAATTG | GTATTTGTTACCGG | CATTGTATCATTTA |
| TCGTGTCATTAGTA | TGACGTTGACATTT | TGTAAGGTTTCCAT | CGTGTTCTGTGGTT |

FIG. 7 (Cont.)

| | | | |
|---|---|---|---|
| GTTTTCCAGTCTGT | TGCCCTGTTGTCTT | TCCTCATGTTAGTT | TCTACTGTTAATAT |
| GTTATTTGTTCGAG | CGAAGTTTGATTTT | GTGTGTGATTTTGC | TTGTGCGATTTATG |
| AGTAGTTTTCCTTG | TTCTTTAGATGGGT | TTTTTGGTGACCAT | TTTCTATCGTTAAA |
| TCATTTCTGTTCCA | TAGACCTATTTCTT | CTTGCAGTCTTTAT | TTTGTCCTCGGTTC |
| GTATGCATTATTTC | ATTATTTACGTCGT | TATACCTTTTTGAA | TTCTCGTCTAATAT |
| TGTTAGTGGTCTCT | TAGTATTTCGTTCC | GGTTTTATCTCGTC | ATTCCTTCCTTGAT |
| ATGTTGATCCTTAT | GTCACTTTCTTAAT | TTTCCGTATTACTC | CCGCTAAGTTTTTT |
| TCTTTCTCTAATGC | TAGCCTGTATGTTT | ATTTCCTCGTTCGT | CTGATTTATGTTGG |
| TTGGTATTCCTATC | CTTTACTTAGATCT | TTTAGGTATTCTCC | TTTCATAGATGTAT |
| CTTGTGATTCTGTA | TTTAGAGTGTTTAG | TTAGCTCCTTCCTT | TTTCTTGGGACTTC |
| TTATTACTCGGATT | CTTGCCTTTTATGC | AACGTTTTCAATTT | CGTGTGTTTGACTT |
| ATTTGTGGGATTGT | TATTGTTATGTGAA | GCCTATTTAGCTTT | GTCCCTTCTTTTCC |
| TACTTGATGTCCTT | GTCCTTAATTCCTT | CATTTGCTGCTTTC | AGTTATACTTTGGT |
| GTAGGCTCATTTTT | TTTTGGTCATCTAA | TCATCTTTCGAATT | GTGGTAGTTTCTGT |
| CTTTCATTTAGTAG | TGTTTGATCGCATT | TATGTCTTCATACT | TGGGCTTTAGTTAT |
| GGATTCTTTTAAGT | TACTTTAGCGATTT | CTTATCTAGTTCAT | ACCTTGCTTGTTGT |
| ATTTCTTGACTACT | ATAGATTTTCTCAT | TAAGTTCTTTGATC | GTGTAAACTTTCTT |
| TCATGGTATTTGCT | TTATCTTGTATGCC | GTTGTTTGGTGCTA | TTCTGACTGTTGTC |
| CATTTATGTTCCGT | TTCGTGTAGTGTGT | CGTATCATACTTTT | CTGTTGTCTTGAGT |
| TTCGTGTTAATTGC | TCTTCGCTTCGTAT | TTTGCGTTCCTCGT | TTTGCCATACTGTT |
| ATCTAGGTTTGTGT | GCTCCTTGTTACTT | TTGCTGAATTCTAT | TTCCCCATGTTTGT |
| GTATGATTCTCTTA | ACTCTTTTCAGATT | ATGTTTTAACGTTC | TTATCATCTATCTA |
| TCCTGTTTCTTAGA | GTGATCTATGATTT | GCTCTACTATTATT | TAGTTTCTTGCGTC |
| TTCATGTTTCACTC | TAACTGCTATCTTT | ATACTTTTTGGTCA | TTGGGTGTTACTTA |
| CTGGTTATTCCCTT | ACTTTTTAGATGCT | CTCTTTTTCGCGTG | TGTTCTTTGCATAA |
| ACCCTTCTATTTTG | TATTTGTGTTACCA | GCTATATTTTGTAG | CTTTCTCTAAAATT |
| CCGTTTCGCTTTGT | TCTCCGTAATTTGT | GAGTGCTTATTTTC | TGATATAGATTGTT |
| ATGATTCTTTCAGT | TGCCCTTAATTTTC | CATTTGATTTACTC | TTACTCGTGTTATC |
| TTGGTTTGCTGTGA | ACGTATCGTTTTTG | TGTGTCAGATTTTC | AATTTTCTACCATT |
| GTCTGGTATATTGT | GTCAGTGTACTTTT | TGTGTTCGTTTGCA | TGTTTGTTACTCGC |
| ATTGCATCATTTCT | TTGCCTTGTGATTA | TCTTATCGAATTTA | TCCGTACTATATTT |
| TTGGATTTTTGGAC | GGGGATTTTAATTT | TGATATTTTTCGAA | CTACTTTAGTGTCT |
| CCCTTTTTGAACTT | TTTGTTGTCGTGCC | GAACTGTTTGTCTT | TCCTGCTTTATTAA |
| CTCTTAGTGTTTCC | ATATTTTGCCCTTA | TTTTGTAGAATGTC | TTATTCAGGTGTTC |
| TCGTTCCTTTCCGT | TCTTATTGGTCGTA | TGGGATTTTCTTCG | TCAGTCTTTTTGCC |
| TGTTACGGTTTTCG | GCTTAAATTTTGTG | GTATATTGTTGCTG | TTATCCTTTCAACT |
| TTCCTTTTTAGAAC | AGTTGTTGATTATA | TGCTTTCTAATTAC | TGCTTTATCTCTGG |
| TGGTTAGTTTAATC | CATTCTGTATTGTG | TACCATTTATAGTT | CTCCTTCTTTGTAA |
| CTTAGTCTTGTCTC | TTTCATTATGGTAA | GTGGTTCTATGTTG | TCAGTTTCTTGAGT |
| TGTTGTTATCAATG | TGTACTTACTCTGT | CTTTTCTTGTCCGC | CTCACTTCTTGTAT |
| ATTTTTAGATCGTG | ATCTTAACTGCTTT | ATAGATGCTTTATT | TTTCATCGTGTTCG |
| TTGTTTATGGTGGA | TGTTATAACTTCTA | TGTTTTACGTTGAG | TCAGAGTGTTTTAT |
| TACATAGAGTTTTT | GTTTATTCGTATGC | TAGTCCTTGTTTGG | TAGTTTTCGTTACC |

FIG. 7 (Cont.)

TTTTCCTTCGCGTC
CGGTTTTATTACTG
TAATAGTGCTTTTA
GTTGATATGTATAT
CAAGTTGATTTCTT
TTATTGTCTTCACA
AGGTATTTTGTGTG
CCTCTCCTCTTTAT
TTTAGGTTGGTCTA
CGGTCTCTTTGTTC
TGTTATGTAACCTT
CTTTATTCGAGTCT
GGTATACTTTCCTT
CAGCTTGTGTTGTT
TTGCGCTTTCGCTT
TAGTCTATTTGACT
GTCGTTGGTTTTTG
GGTTTATTGATTTA
GTTTTTATGCTATA
TGCTATTTTCGGTT
TATTGTCTTTTCAC
TTGTCCTGGGTTTT
TCTTTTGGCTGTTG
ACTTCGACTTTTTT
TGCTTTTCTTACCT
ATGATCCTTTTTTA
TTTCTATTGTGTGC
TATTTCCTATACTT
GTTTGTTTATTGAG
GGATTGTTTTCTTC
TGTATCCATTTTGT
CCTATTTTCTCGTT
ATTCTTACTGTATT
TTGAGTTTATCTTC
CTTCTTCTCTTCTG
TTGTGTTCTATAAT
GTTTGAAATCTTTT
GTCCTTTGATGTTT
TGTATATTGTTGCT
TTGTCTCGTTGTGT
TCGTACTATTTTTC
CTTTTATTACCTTA
TCAGTCTTGCTTTT

GTGCTTTTCCTTTA
TCATTTCACTTGTT
GATTTTTCTCAGTT
GTATTGGTTTTGCT
TATCCTTTGCTTGT
CTTTTGCTTGCTTG
TTTGTTGCTTGATG
TCTTTGGATTTTCC
ATTTGTGTTTGCTG
TGTACGGTTTTTTA
CCGTAATTATTTTT
TTTTTGCGTAGATT
GTGTTCGTTGTATT
TCTCATTATCTTTG
TGGTGCTTCCTTTT
GTTTTTCAATGCTT
TTGCTTGATTAATT
TATTTTGTCTTGAA
CTTTATTGCTTTAG
GTTCCATTTTCATT
GTTAGTTGTTTACT
TTTCTCTGTAATCT
CCTTTTCCTTGTCT
TTCTTTGAGTGTTA
TTACTGTCTTGCTT
TCCTTATTTTTGGG
TTTGTGTAATTCCT
ATGTATTTTTCGCT
AATACTTTTTGGTT
CCTTTATTCGGTTT
TTCGATCGTTTGTT
GTTTTACTTTTCGG
TTTACTCTGTATTC
TTTAGTCTGTTAGT
TTGTTTTCATCATG
AGTTTTTCCATTTT
ATCGTCTTTTCTTT
ATTGTGTTCTTATT
TTCCGTATTTGTTT
TAGTGTTTTTGTTG
CTTTGCTTGTTTTG
TTTTCTTTCGTTGA
TTGCTTCTATTTGT

TTTTTGGTATTCTG
TATTTTTCGTGTTT
GTTTCGTTATTTTT

FIG. 8

| Gene Name | Forward GSP | Reverse GSP |
|---|---|---|
| ABCF1 | CTGGAGAGTCACGCCCACA | GGCTGACAACGATCACAGCA |
| ACAD9 | CTGGGGCTGACAGGCAACCA | GGCCACCCGCTTCAGTACCA |
| ACTB | CCACACAGGGGAGGTGATAGCA | ACCCACTCCCAGGGAGACCA |
| AGK | CTGGGCACAACCACAGGA | TCAATGGTGGACAGCTGCA |
| ALAS1 | GTGAACCGGCGAGCACA | CCACCTGCCCCAGCACCA |
| AMMECR1L | GTGCACTTAAGGACAGCCGA | CATGGACCCCTACCTCCCA |
| B2M | ACGTCATCCAGCAGAGAATGGA | TGGTTCACACGGCAGGCA |
| C10orf76 | AACACAGGCTTCACAGTGGCAA | CCATCAGGTCCAGTACTGCACA |
| CALM2 | TGGGCAGAATCCCACAGA | ATGGCGAAGTTCTGCAGCA |
| CC2D1B | GGATCTGAAGCCCCAGCA | CTGTGACTCTGTAGGGGCCA |
| CFAP157 | CGGTACCAGCGGAAGTGGGA | CGTGCGCTTGAGGAAGGCCA |
| CIAO1 | CTCGGATCCACAGCAGCCCA | CTCCCCATCATCACTGCAGGA |
| CNOT10 | CCCCTCAGTGCTACCCCA | TTGAAGCCGCCTGGTGGA |
| CNOT4 | GAACCACACAGCAAACCCCA | TGTGAGGGCCTGAAGGGA |
| COG7 | TAACCAGCAGGCCCACCA | GTGAGACTAAAGGCGGGCA |
| DDX31 | CTGGACAAGAGCCATGACCA | TGTAGGAAGAGGCTGTAGTGGA |
| DDX50 | CATCTGCAGAGTGGCCGA | CACTGTGGGCAAGTTGCAGA |
| DHX16 | TCCGTGTACGCAAGGCCA | AGCCACCTCCAGAAGCCA |
| DNAJC14 | TGCATCCTGCTGAGGAAGGAGA | CACGCTGGCATCCAGCCCA |
| EDC3 | CGGGCACCAGTACTCAGCA | CTTGCAGCCAAAGGGCGA |
| EIF2B4 | ATCTGCAATGTAAGCGGGGAGA | GGATCATCCCCAGCTCCGTGA |
| EIF3B | TCAGTCCAAAGCCTCAAAGGA | CCCCTCCTCGCAACTCCA |
| ERCC3 | GAGTGGCTCAAGACCCAGGA | GGGCACCAGACCTCAGCA |
| FCF1 | AGAAAAGAAGGATCCCAGCGCA | GGATGTGGTAAGGTGGGCCCA |
| G6PD | CCATCTGGAACCGGGACA | CTCCATGGCCACCAGACA |
| GAPDH | CTGGGCTACACTGAGCACCA | CCACCCTGTTGCTGTAGCCA |
| GPATCH3 | GATGGCCAACACCCCAGA | ATGAGGGGCTGTCTGAAGCA |
| GUSB | GCAAGACAGTGGGCTGGTGAA | CCCAGTCCCATTCGCCACGA |
| HDAC3 | CCTCAGCATCCGAGGGCA | CGGGCAACATTTCGGACA |
| HMBS | TCTGGAGTCTAGACGGCTCAGA | TACGAGCAGTGATGCCTACCA |
| HPRT1 | ATGACCAGTCAACAGGGGACA | TATACTGCCTGACCAAGGAA |
| HSP90AB1 | CCAGACCCACTCCAACCGCA | AGAGGGGGGATCTCATCAGGA |
| LDHA | AAAATACAGCCCGAACTGCAA | CAAGGACCCACCCATGACA |
| MRM2 | GACCCGAGAACCTCACAGAGA | ATGTCTGGGGTCACGCTGAGA |
| MRPS5 | GAAGCAAGGAAGAGCAGGAGA | CAAGACTGATGCCTCCCCA |
| MTMR14 | GAGAGACTCGGCTGCAGGA | CCGATGGCACCGGAAGGA |
| NACA | CACCCACAACTACCCTAGCCA | AAAGGTGCAAGATGAGAGCCCA |
| NDOR1 | CACCCCTCACGGCTGCAGA | GTGTCTCTGGGAAGGCCAGA |
| NOL7 | CTGTTGCTCGGGCAGCCCA | CTGGGCGCTGGCGAAAGTCA |
| NONO | GATGGAAGCTGCACGCCA | GCCATCTGACCCATCCGA |
| NUBP1 | CGGAGCTCATGTGCCAGGA | GGCTAACGTGGCTGGGGA |

FIG. 8 (Cont.)

| Gene Name | Forward GSP | Reverse GSP |
|---|---|---|
| PGK1 | CTGCTTGGACAATGGAGCCA | GAACATCCTTGCCCAGCAGAGA |
| PIAS1 | CAGTATCCCGCACCCCAA | GAAAAACCGAGACGAGTGTAGGA |
| PIK3R4 | TGGGTCACTGGACCCACCAA | CAAAGGGACACAAATGCCAGCA |
| POLR2A | GCATGGAGATCCCCACCA | CTGGCATCTGACGCAGCA |
| PPIA | GCAGAGGGTTAAGGCGCAGA | TTGCAAAACCTCAAAGCCTCCA |
| PPIH | CTGCACCGGAGAATTCAGGA | GCCATGGAAAGCAGGCCTGGA |
| PRPF38A | CACACTGCGCTACAGGAGGA | CGGGATCTGTGCCGCCGA |
| RBM45 | AAGTTCGCCCGCAGCTCACA | CCAGATGATCGGGACTGAGCA |
| RPL13A | CCACAAAACCAAGCGAGGCCA | TTGTAGGCTTCAGACGCACGA |
| RPL30 | GTGGCCGCAAAGAAGACGA | GATTTCCTCAAAGCTGGGCA |
| RPL5 | AGATCTATGAAGGCCAAGTGGA | TGGCAAGGCCTGCATCCA |
| RPL8 | CTCCCACAACCCTGAGACCAA | GATGGTGGAGGGCTTGCCGA |
| RPLP0 | TCACTGTGCCAGCCCAGA | TGCTGGATGACCAGCCCA |
| RPS19 | GGAAGCTGAAAGTCCCCGA | CCCCAGCGCCACCCCGGA |
| SAP130 | ATACCCACTGGCGGCACA | GACGGTAGACGCTACCCCA |
| SDHA | GGGAAGCGTGTTGCAAGAA | TAGATGGTCTGCAGCGCA |
| SF3A3 | CCAAAGCCTTCCAGCGACA | GGCCCACAAGGAGACAGCA |
| SLC4A1AP | TTGCACCTGGGGAATGGGAGA | CTGAGTGAATGGCCTCAGCCA |
| TBP | CCACGCCAGCTTCGGAGA | CGGCGTTTCGGGCACGAA |
| TFRC | GGCACGAGCAGCTGCAGA | TCCACGAGCAGAATACAGCCA |
| TLK2 | CGATGCTTGGCCTACCGA | GCCCCAGAGGTTGATGCA |
| TMUB2 | CCCCCCTGAGATCTGAGGA | TTCAGGGCACCCACGGTA |
| TRIM39 | TAGACTATGAGGCCGGCACA | TCTTCCGTCCAGCCCGGA |
| TTC31 | CCCTCCAGCCACTTCCCCA | GGTCCTGGGGCTTGAGAGGA |
| TUBB | GCTCTCACAGTGCCGGAA | TGGACATCCGACCACGGA |
| TUBB2A | GAGGAGGAGGGCGAGGACGA | CTAACAGAGGCAAAACTGAGCACCA |
| UBC | CATCCCTCCTGACCAGCAGA | GAGACGGAGCACCAGGTGCA |
| USP39 | GGCACATGTGTCTCCCCA | TCCTCATGGACCCCTGGA |
| VPS33B | GACCGACAAGGCTGCAGGAA | CTCGCCGTCCACACGTGGGA |
| YWHAZ | AAAAAACAGCAGATGGCTCGAGA | TCTTGTCATCACCAGCGGCA |
| ZC3H14 | CCTGCAAAGCCTTCCCCA | CAAGCAGGGAAGTAACGGCA |
| ZKSCAN5 | CATCAGCGCGTCCACACA | GAGTCGAAGATGTCCAGCCA |
| ZNF143 | GCAGGCTGTGGGAAGGCA | GTTGTAAAGGACCGACCGCA |
| ZNF346 | CACTACCTGGGGAAGACCCA | TGCATGGCAGAGGCTGCA |
| ZNF384 | CTTCAGCAGCACACCCGA | GTGGGACTGCAGATTGGAGA |
| A2M | CAGTTCCTGAACACGGAAGGAA | AAACCTCACCACCTGATGGACA |
| ABCA7 | GGGGGACACATTGGCCAGCA | GATGGCATCGGATTGAGGGCA |
| ABCA8 | AGGGCTGAGGAAAGGGGA | GGTCGACGGCTCATCCAGA |
| ABCB1 | TCCGAGCACACCTGGGCA | AGGGCACGAGCTATGGCA |
| ABCC1 | CAACGGGACTCAGGAGCACA | AGCTCATGGGTGACCGCA |
| ABCG2 | GCACTGGCCATAGCAGCA | TACTGAAGCCATGACAGCCA |

FIG. 8 (Cont.)

| Gene Name | Forward GSP | Reverse GSP |
|---|---|---|
| ABI3BP | AGATGGACGCACTGGGCA | GGACAGGTTCCTGGCGAA |
| ACAN | GGGAGGTGTTCTTCGCCA | TGACGATGGGGTAGCGGA |
| ACE | TTCCAGGAGCTGCAGCCA | CTGAAGGGAAGGGCACCA |
| ACHE | TGCCCCACGGCTACGAGA | GCGGGCAAAGTTGGCCCA |
| ACKR1 | TGGCAGAAGCCCTGGCAA | ATCCTTCAGGGAGGGGCA |
| ACKR3 | AGGAGTGGCTGATCGGCA | TGTCCAGCAGCACCGCCA |
| ACP2 | AAGGAGGGGATGCTACAGCA | TTGGCCTCAGCACTCATGAGA |
| ACTN1 | TGATCAGCTGGAGGGCGA | TGGCATCCCGGGTCAGGA |
| ACVR1 | AGCCATTGCCCATCGAGA | TTGGTGCCCACACGGGGA |
| ACVR2A | AGTTACACCTAAGCCACCCTA | ACAAGTACAGGAGGGTAGGCCA |
| ACVR2B | ACGGACAGGTAGGCACGAGA | TGCAGCCTTGCAGCGAGA |
| ADAM10 | AATGCAAACTGAAACCTGGGA | GCTGGGCAGAGAGCTGTGA |
| ADAM12 | CCGCCAGATTCCTACCCA | GGTGGAGGGGAGGAAGCA |
| ADAM15 | CAACCAGCTCCCTGACCACA | GCCGTTCAGAGGGACCAGA |
| ADAM17 | CTGCGAGAGGGAACAGCA | TCAGCATCGACATAGGGCA |
| ADAM19 | CCGCCCTTCTGCAACACA | GCCTCAGCTTGGAAGGGA |
| ADAM22 | GATAGTGGAAGCCACCCCA | GCTCAGGAAAGCAGTTGCCA |
| ADAM8 | GAGCAGACTGCACCCCAA | CAGCCCTGCTGAACACACA |
| ADAM9 | ACCCTTGCTGCGAAGGAA | TACCTCCTGGAAGGAACCGA |
| ADAMTS15 | CGGAAAGAGCTTCCGGGA | TGCCTTGGACACAGACGGA |
| ADAMTSL4 | GGGGAACCTCACTGACCGA | GACCCAGGGGGATCCACA |
| ADGRA2 | CCTCTGGCACAGAACCCCA | GGAAGTGCGTGGTCACCA |
| ADGRA3 | CGTGGCAACAGCTCGACA | GCGCTGAAGACACTGCACA |
| ADGRE1 | TCTTCCTCGCCGGTATACACA | AACAGTATCACAGCCTCCACCA |
| ADGRE2 | CCCTCCGGAACACAAGGA | GAGGAGGCAGTACACCAGGA |
| ADGRE3 | CTGGCCGCCTTCACCTGGA | AACGCCATAGCCGACTGGGA |
| ADGRE5 | GGCAGCACCACCTGCCAA | GGAGCCCACGAAGAGGCA |
| ADGRF1 | AAGACATCGTGACGTGCCAA | AAAGCCTCGATGATCAGGCA |
| ADGRF5 | CCATGCAAGCAGGAGAAGAGCA | TACCTTCAGATCCCAGAGGCA |
| ADGRG1 | GGGTGTGAGACCGTCAGGA | TGGTGACAAGGCAGGCCA |
| ADGRG2 | ACATGGATGGGCCTAGAAGCA | CATCCGGTGAACCATTGGGGA |
| ADGRG6 | CTGGATGGGGCTAGAAGCAA | TGACACCACTAAGGCAGGCA |
| ADGRL2 | TCTCATGGCCCACAGGGAA | TGAAGATGCAGATAGCCAGGCA |
| ADGRL4 | ATCTAAGCCCAGCCGTGGTA | CAACCCTGCAGTGTGACGA |
| ADIPOQ | CCAGGCCGTGATGGCAGA | CCCGGAAAGCCTCGGGGA |
| ADORA1 | CCAAGTCGCTGGCCCTCA | CTTGTGGCAGGACGGGCA |
| ADRA2A | GGTGCTCCGTGCCACGCA | TCTTGAAGGCGCGGCGGA |
| ADRA2C | CCATCAGCCTGGACCGCTA | GACGGCCGAGATGAGCCA |
| ADRB2 | CCACCCACCAGGAAGCCA | TGAAAGACCCTGGAGTAGACGA |
| AEBP1 | TCCCCATTGCCAACGCCA | TCCAGTTGGAGCGAGCCA |
| AGRN | CAGGGTCTCACTGGAGCGAA | ATGGCACCGTCGAAGCCA |

FIG. 8 (Cont.)

| Gene Name | Forward GSP | Reverse GSP |
|---|---|---|
| AGTR1 | CCCGCCTTCGACGCACA | GGCCCAGCCCTATCGGGA |
| AGTR2 | ATAACCCGTGACCAAGTCCTGA | GGAACCCTAAACACACTGCGGA |
| AHSG | AGCTGGCTCACCCCCAGA | CTCCTGAGGGTGACCCCA |
| AKT3 | ATGCAGCCACCATGAAGACA | GACAACCCCTAGGCCCCA |
| ALB | TTGGTGAACAGGCGACCA | TCACGAGCTCAACAAGTGCA |
| ALCAM | ACACGATGAGGCAGACGAGA | ACACCAGCAACAAGGGCA |
| ALK | CAAAGAAGGAGCCACACGACA | CAGCGAAGAGGGCTCTAGGA |
| ALPL | TGCATGAGGCGGTGGAGA | CTCGTTCACCGCCCACCA |
| ALPP | ACAGCCAAGGTGGGACCA | CACAGACGGGTCCAGGGA |
| AMBP | CTGCCAGGGCAACGGGAA | CTCATCACCATCACCAGGGA |
| AMIGO1 | GCAGGTGCAGGTCGAGGA | AGGACCAGGACCACACTAAGGA |
| AMIGO2 | GACTCCATGCCCCTGCAA | CGTTCATCAGCGGAGGCA |
| ANGPT1 | CAACTGGAGCTGATGGACACA | CCAACCTCCCCCATTGACA |
| ANGPTL1 | CAAGCAAAAGAAGCTGGGCA | TGAATAACAGTCCAACCCCCA |
| ANGPTL2 | TCACCACCCTGGACAGAGA | TCCTCGGAACTCAGCCCA |
| ANGPTL4 | GGGACAAGAACTGCGCCA | CCCGCCAGGTCTTCCAGA |
| ANO5 | AAACCACACTGCACCTTCGGAA | ACATCAGGTATCATCCAGGCCA |
| ANO6 | GAAAGCCCAAGACATTGGAGCA | AGTAGTACACTAGGCGGGGGA |
| ANO9 | ATCCAGTACGGCTTCACCACCA | GCACACCGATGGTCTCCAGCA |
| ANP32B | GACTCAGATGCCGAGGTGGA | CTGACTTCATCGTCGTCCTCA |
| ANPEP | GCTACACCCTGAACCCGGA | GGAGAACGAGCCACCACCA |
| ANTXR1 | GGGAGAAAAGGGCTCCACA | TCAGTAGGACCCACAAGGCA |
| APCDD1 | TCAACGGTCAGAGGCCCA | GAGGAGGCACACTGGACCA |
| APLNR | GTTACGCACCACCGGGGA | CCACGGTGGTGGACGAGA |
| APLP1 | CCGAGAAGGCACAGCAGA | TCTGGTCAAGCAGGCCCA |
| APLP2 | CTCGAGGAAGAGCGGGAA | CATCACCAGGCTGATGACGA |
| APOB | CTGACCTGCGCAACGAGA | GAATCTGGGGCAGGCCCA |
| APOD | GCCACCCCAGTTAACCTCACA | GGATCCAGTACGGTGCCGA |
| APOE | AGGAGCAGGCCCAGCAGA | CTTCCACCAGGGGCTCGA |
| APOH | AATGGAGCCGTACGCTATACGA | GGAGGGCAGATGATGGGA |
| AQP1 | CTGGCTACTACCGACCGGA | GTGTGTGATCACCGCGGA |
| AQP2 | CAGCTGTCGTCACTGGCAA | CGAGTGCAGCTCCACCGA |
| AREG | CGGTGTGGGGAAAAGTCCA | AGCAACAGCTGTGAGGATCACA |
| ARSF | GTCGCATCAGTGTCAGGAGGA | TGAGCCTTCCAAACTGACCCA |
| ASIC1 | CATGGTCAAGATCCCCAGCAA | GCCCCGATGAACAGCCCCA |
| ASPN | GGTGCAGCCACACCAGGA | GCAGAGCACAAAGCCAGGA |
| ATM | CCGATGGCAAGGAGAGGA | CACTTCGCTGAGAGAGGGGA |
| ATP1A1 | GGAATGATCCAGGCCCTGGGA | TGATCCAGCGGTCATCCCA |
| ATP1A3 | CGCTCTGAAGAAGGCCGA | CCTGTGACGATGGAGGCA |
| ATP1B1 | CCCCGCCAGGATTAACACA | TTCGGTTCACTGGGCACA |
| ATP1B2 | GAATGTGACCCCCAACGTGGA | TTGATGCGGAGTTTGAAGGCCA |

FIG. 8 (Cont.)

| Gene Name | Forward GSP | Reverse GSP |
|---|---|---|
| ATP1B3 | CAGAGCCTGGCCGAGTGGAA | AAGAGTGCAGCCAGGAACCCA |
| ATP6AP1 | CAGCCCTCTCCCTGGCAGA | CGGGGGAGAAGAAGCTGGCA |
| ATP6V0A2 | GCTTAGCCTGGCTCACGCACA | TCTACCCAGTGGAGGCGTA |
| ATRAID | CTGCCTGAATCAGAAGGGCA | AGCCACGGAAGGTGTTGGCCA |
| ATRN | GAGATTGCACCAGCGGCA | AAGGAGGCCACGTAGGCA |
| AXL | CCCAGCCAGACCCTAAGGA | AGGGGTTGTGGAAGGGCA |
| B3GAT1 | AGATGCGCAGCACCAGGA | ACACCGTCTTCCAGCCGA |
| BACE1 | ATCACCATCCTTCCGCAGCAA | AAGACAACGTAGAAGCCCTCCA |
| BATF | GCCGACAGAGGCAGACACAGAA | CTGTTCAGCACCGACGTGAA |
| BCAM | GGATTACGACGCGGCAGA | GCACGGAGCAGTTCACGA |
| BCAN | GCACACCCGAGGAACAGGA | GGACGCCATCCGACCACA |
| BCHE | TCCTGAGGCTCCAGGGAA | GAGATGTTACCGCCCAAGGA |
| BCL2 | GGGGTGAACTGGGGGAGGA | CTCAGTCATCCACAGGGCGA |
| BCL6 | GTTCAACCGGCCAGCCAA | TAAGCACATGGGCACGGA |
| BDNF | CCAGAAAGTTCGGCCCAA | GCCGGACCCTCATGGACA |
| BGLAP | CCAGGAGGGAGGTGTGTGA | GGGCCGTAGAAGCGCCGA |
| BGN | CGGGCCTACTACAACGGCA | CAGGCGGTCAGTGACGCA |
| BLK | AGGGATGAGCAACCCCGA | CCAGCACCGACTGCAGGA |
| BMP1 | CATTGCCCAAGCCCGCAA | GCCTTCCTCCAGAAGCCA |
| BMP4 | GGGCACCTCATCACACGA | CACCTCAATGGCTAGCCCA |
| BMPR2 | CTGCCACAACCCAATATGCCAA | CAGCCGGGTGTCCTCACCA |
| BSG | CATCCGGGGGCAGCTCTGGA | CTCCAGGGGTGAGCTGGGGA |
| BST1 | CGTGGACCACAGCACCCA | CCTGGAAGCCAGCACCAGA |
| BST2 | CTGCAACAAGAGCTGACCGA | GGGAAGCCATTAGGGCCA |
| BTD | TGGCTGGGAGAATGACCA | CCTCTCATACAAGCGCCCA |
| BTLA | CGACCCTCCAAGGACGAA | CAGGCAGCAGAACAGGCA |
| BTN2A1 | CAGCCCAGGAAAACGGCA | GATATGCACTCCAGCCGGA |
| BTN3A1 | TATCGGACTCTAACTGAGCCCA | TGCGATCCATCCACAGCA |
| BTN3A2 | GAGAGGCGGCTCCGGGGA | AAGCAGCAGCAAGATAGGCA |
| BTN3A3 | AGCCCACTGCCCTGACCA | GGTGGGCAGGGAGAAGCA |
| BVES | AGAGTCCAGCCCATTGAGAGA | ACATCGGTAGAGAGTGGCCCA |
| C11orf24 | GGCACCGGAGCAGGTAGAGA | GGGGCTCAGTGGTGACCA |
| C12orf49 | AACGTCCCTAGCACGAAGCA | CGGCTGCCCGGTTGAGGA |
| C1orf159 | GCTGGAACGCGGACGGGA | AATGGCGCACCCGGGCCA |
| C1QTNF2 | ACAACGGCCAGTACCGCA | GTCACCCTGCTTGAGAGCCA |
| C3 | CCATCACCACGTGGGAGA | CAACAGAGTAGGGTAGCCGCA |
| C4A | GCAGCCTGTGCCCAGCTCAA | TCCTCCCAGCGGAGGTGGGA |
| C4BPA | CCTAGGCCGACAAAAGAGGA | CAGGGCAACATAACGCCTCA |
| C4BPB | GAGGACCACACCTGGGCA | CCACTCCCCATCAACGCA |
| C5AR1 | GGCCTCTACTCACGCTCACGA | GGTGACGATGGCTCCAGGA |
| C6orf120 | ACCCCTCCCACCTGGAGA | CGAACGGGTGCTGCTCGA |

FIG. 8 (Cont.)

| Gene Name | Forward GSP | Reverse GSP |
|---|---|---|
| CA12 | TACTGCACACACATGGACGA | GAATGCCAGCCAGGGCCA |
| CACHD1 | ACCATGAGCCCACAGGAGGA | AGTCTGAGGGGGGGTATCCA |
| CACNA2D1 | GCAGGACATCGCTCAGCA | AGGGAGGCCGTGAAGTCA |
| CACNA2D2 | GCTAGTGCAGAGACCGCGA | GAGCAGCAGTTGCAGGGA |
| CADM1 | AGCCATCGGGAAGCCCCA | ATGAACAGGTTGGGCCCA |
| CADM2 | CCAGAATGGCCCTGACCA | TTGCCAGATATCGACCAAGCA |
| CADM3 | GGCACCTACGGCTGCACA | GAGCATGATGAGCAGCAGGA |
| CADM4 | TGTGGTGAGGGAGGGAGACA | GCGGATACCAGACCCGGCA |
| CALCR | CTGGCTGAGTGTGGAAACCCA | TTGGTCACAAGCACCCGGA |
| CALCRL | AAGAGCCTAAGTTGCCAAAGGA | ATGCCTTCACAGAGCATCCA |
| CALR | GGCACTTGGATCCACCCAGA | GTGCCAGACTTGACCTGCCA |
| CALU | AGAATGGGTAAAGACAGAGCGA | CATAGTCTGAGGGAAGGATCCA |
| CANX | GACGCAGAGAAACCTGAGGA | AATCACAGGTCGCTGCCA |
| CAPNS1 | AAACAGTTCGACACTGACCGA | CACGGAACATGGCGTCCA |
| CASD1 | TGGAAAGGCTGGATGCAA | ATGCAGCAACCAGAACTCGA |
| CAV3 | ACGGCGTGTGGAAGGTGA | CAGAAGGAGATGCAGGCGA |
| CCDC126 | CAGCAGCCAACACCACCA | CAGTGGATGGAGCAGCACA |
| CCDC80 | GAGGACCCAAGGAGAGCACA | TGAGGGAGGTTGGGGCAA |
| CCL1 | GCTGAGGCACTGCCCGTCAA | AGCAAAAGCAGGGCAGAAGGAA |
| CCL13 | CAGATGCACTCAACGTCCCA | ATGACAGCCTTCTGGGGACA |
| CCL17 | GGACCAATGTGGGCCGGGA | CAAAAACGATGGCATCCCTGGA |
| CCL2 | AGGGCTCGCTCAGCCAGA | CTGCTTGGGGTCAGCACAGA |
| CCL22 | GCGCCAACATGGAAGACA | GGTTAGCAACACCACGCCA |
| CCL7 | GAGACCAAACCAGAAACCTCCA | TGAAAGCAGCTGCTGTGAGCA |
| CCR1 | GGTGATCGCCTACACGCA | CCACGGAGAGGAAGGGGA |
| CCR10 | TCTACTGGCTGCGCGCGA | GCCCAGGAAGGCGTAGAGA |
| CCR2 | TACCAACGAGAGCGGTGAA | TAAGATGAGGACGACCAGCA |
| CCR3 | GCTGCATGAACCCGGTGA | GCCCAGGTGCATGAGCAA |
| CCR4 | TGATCATCAGGACCTTGCAGCA | GCTCCACCAGGGTCTCTAGGA |
| CCR5 | GTTTGCGTCTCTCCCAGGAA | CCATGACAAGCAGCGGCA |
| CCR6 | GCATGGACCGGTACATCGCCA | GATGATGACTGACAGCCCCCA |
| CCR7 | GGCCCAGACGGTGGCCAA | TGCGGAACTTGACGCCGA |
| CD101 | TGATGAGCCGTCAGCCGCAA | GCTGGAACTGCCACGTCACA |
| CD109 | GCTCCAAGCCTTCCAACCA | CCCCATCCTCACTGGGAA |
| CD14 | CGCTGCGCAACACAGGAA | GTTCAGGGCGCTGGACCA |
| CD151 | CTGGCGAGACAGTGAGTGGA | CACCACCGTCTTGCAGCA |
| CD160 | GGGAACTACACAGTGACGGGA | GGGCCACAAGGCTGGTGA |
| CD163 | ATGGGAGAAGAGACTGGCCA | GGTCCAGTCCCCTGACCA |
| CD164 | AGCACCCGAACGTGACGA | GGTGACCAGCGGGAGGGA |
| CD177 | CCCCGAATGACCTGCCCCA | TGAGAGACTCCAGGCCCTCA |
| CD180 | TAAGCCACAACAGCCTGACA | AGGGAGGAGACGGGGTGA |

FIG. 8 (Cont.)

| Gene Name | Forward GSP | Reverse GSP |
|---|---|---|
| CD19 | ACCGTGGCAACCTGACCA | CCACAAGGGAACACAGGCA |
| CD1A | GCGGCAAGTGAAGCCCGA | TCCCATCAGCACTGGGCA |
| CD1B | TTGAGATCCAGGGCATAGCA | GGGAAGGCACACATGAAGCA |
| CD1C | GAACAGGAGCAACTGGGCA | TCACTCGACAAGACAGGCCA |
| CD1D | GCACTCAGCCAGGGGACA | GGAACAGCAAGCACGCCA |
| CD1E | GGGAAGTCAGCAGAGGGAGA | GAGGAGGAACAGGAGCAGCA |
| CD2 | CAGCAGGGAACAAAGTCAGCA | GAAAACGAGCAGTGCCACAA |
| CD200 | TGTCTCACCCAAATGGGACCA | TAAAGTCGGTCACAGTCCCCA |
| CD200R1 | GAGGCCAGCCTTCCTGCACA | TCATGAGTGATGGCCACGGTA |
| CD207 | GACCTCAGAGAGTGAGCAGGA | GAATGGCGTGTCATCCACCCA |
| CD209 | CCAGCGGAACTGGCACGA | CAACAGAGGTGAGCCGTCCA |
| CD22 | CTGTGAGAGCGACGCCAA | GAGGGTGCTGAGAGGCGA |
| CD226 | GATCGGGACCCAGCAGGA | GAGAGCAGGAATAGTAGCCAACA |
| CD24 | GGGACATGGGCAGAGCA | GGCCAACCCAGAGTTGGA |
| CD244 | CCAGGAAGTCTGGATCCAGGA | TCTTTGCGGCTCAATCGAGCA |
| CD247 | GAAGTTCAGCAGGAGCGCAGA | CCATCTCAGGGTCCCGGCCA |
| CD27 | ACCCACTGGCCACCCCAA | GGCTCTGCAGGCTCCACA |
| CD274 | GTGGTGCCGACTACAAGCGAA | GGGTAGCCCTCAGCCTGACA |
| CD276 | GCAGATGGCCAACGAGCA | GAGACAGACAGACAGCCCCA |
| CD28 | GGTGAAGCAGTCGCCCCA | TACAACACAGACTTCCACAGCA |
| CD300E | CGAAACCTCAGCACCGGGGA | TCACCCAGAAGACAGCACCCA |
| CD300LF | AGCAGAAAGCAGCCGGGA | CCTTCGGCAAGGAAGCCA |
| CD302 | CTGCACATCAAGACAGGTGA | TACCGTGCTAGCAATCACCA |
| CD33 | AGACGCCAGGAGGAGGGA | GCTCACAGGCCCAGGACA |
| CD34 | GACCTCCAGCTGTGCGGA | GTTCTGTTGGCCAAGACCA |
| CD36 | AACCCAGGACGCTGAGGA | GCAGCTGCCACAGCCAGA |
| CD37 | CTTGTCGGCGACCAACGA | TGTGGCTCTCTGCAGGGA |
| CD38 | CACAGGTCCAGCGGGACA | TGAGCATCACATGGACCACA |
| CD3D | TGGACCTGGGAAAACGCA | CTGGATCCAGCTCCACACA |
| CD3E | CCAAGCCTGTGACACGAGGA | GCGTCTCTGATTCAGGCCA |
| CD3G | CCAAGGACCCTCGAGGGA | CTGAAGCTCTCGACTGGCGA |
| CD4 | CTGCTGAGTGACTCGGGACA | GCCGGCACCTGACACAGA |
| CD40 | TGGACAAGCTGTGAGACCA | CAGCACCAAGAGGATGGCA |
| CD40LG | TCAGAGCTGCAAATACCCACA | GCCAAAGGACGTGAAGCCA |
| CD44 | TCAGTCACAGACCTGCCCAA | TGGACATAGCGGGTGCCA |
| CD46 | GGAGCGGTAAGCCCCCAA | TGGAGCAGCACGACTCCA |
| CD47 | TGCTGCGGATCAGCTCAGCTA | TAAAGTCAGTGGGGACAGTGGA |
| CD48 | GAAAGAGGACAACAGCACCTACA | ACAGACTCGCCAGGTATCACA |
| CD5 | CAGCAGCATCTGTGAAGGCA | GCGTCCAGCACTCGATAGGA |
| CD52 | GGACAAAACGACACCAGCCA | CAACTGAAGCAGAAGAGGTGGA |
| CD53 | AGCGTGGGACTCCATCCA | TCGCATAGCAACCCTCCA |

FIG. 8 (Cont.)

| Gene Name | Forward GSP | Reverse GSP |
|---|---|---|
| CD55 | CATGCCCTAATCCGGGAGA | ACGGGTCACTCCACTGGACA |
| CD58 | CAGAGGCCGGCCCGACGA | GCAGTGCAGCAGGCAGACCA |
| CD59 | ACAACCCGCTTGAGGGAA | AGAAATGGAGTCACCAGCAGA |
| CD6 | GCCACCCTTGGAGGAAGGA | GGGTGATACTGAGGGCCCA |
| CD63 | TCAACGAGAAGGCGATCCA | GCTGCTGCAGCTACCACCA |
| CD68 | CTTCCCCCACGCAGCACA | ACCAGGGCGAGGAGGCCA |
| CD69 | CAATGCCATCAGACAGCCA | AATGACAGCAAGAGTAGCACCA |
| CD7 | TCTCAGGGTCCCAGGACAA | TCCTCTGTCACCAGGACCA |
| CD70 | GCATGGACCAGAGCTGGACA | AGCAGATTCCCACGGCCA |
| CD72 | GCAGCTCCAGCAGACGAA | CTTCCTGACTCTGCGCCA |
| CD74 | CCCCGGAGAGCAAGTGCA | CCTGGCCAGCGAGGAGCA |
| CD79A | GGCAACGAGTCATACCAGCA | CCGCGCAGAACAGGAGGA |
| CD79B | GGACGAGAATCCCCAGCA | ATGGTGAGGGTGGCGAGA |
| CD80 | AGCTGGCACAAACTCGCA | CGCAGAGCCAGGATCACA |
| CD81 | CTATGACCAGGCCCTACAGCA | AGTCAGTGTGCTGGAGCCACA |
| CD82 | TGCAGGAGAACCTGGGCA | GGAATGGACGTGCCGGCA |
| CD83 | CCCCCAATGAAAGGCCCTA | GTGCAGGGCATCCTGTCA |
| CD84 | TACACGTGTACAGCCCAGA | GAACATAGCCAGCACGCTCA |
| CD86 | GAAGAAGCGGCCTCGCAA | CACGCTGGGCTTCATCAGA |
| CD8A | GCCGAGAGAACGAGGGCTA | CTGGCAGGAAGACCGGCA |
| CD8B | GCTGACCTTCGGGAAGGGAA | TGGCCTGGGTAACCGGCACA |
| CD9 | GAAACGCTGAAAGCCATCCA | TGATGGCATCAGGACAGGA |
| CD93 | CCAGCATCCATCACGCCA | CAGGAGTAGGATGGCCACCA |
| CD96 | ACCAGCACAGCCAGAGCA | GCTGCTACAATCACTGGCCA |
| CD99 | AGAAGGGGAAGAGGCCGA | CTCCAGCCACGGCGACCA |
| CDCP1 | CTCTAACTGCAGCCCCACGA | ATGATGAGCCCGAGGGCA |
| CDH1 | GATGCCCCCAATACCCCA | CCAGCACATCCACGGTGA |
| CDH10 | CAGCACAGGCACACTGACCA | TGCAGAGGAGGATGGCGA |
| CDH11 | TCTGAACGCCGGCCTGAGCA | CAATGACCAGGAGAATGACGATGCA |
| CDH13 | CAGGGAAACCACCCATGACGAA | TGAGGGCAGGCTGAAGCGCA |
| CDH15 | CTTCGGACCAGCCTAGCAGA | TGGGTCTGGATCCGGCCA |
| CDH17 | ACTGTCTACCAGGCACACAGA | GCCCACAGTGGGTATCCCA |
| CDH19 | CACAAGCGCTGAGATCAGGA | AAAAGCGTAGGTCTGGAGGGA |
| CDH2 | CTTGAGCCAGCTGCAGCA | GCTGCAGATCGGACCGGA |
| CDH3 | TGACGGTGATCAGGGCCA | GCAGCACCAGCAGGAGGA |
| CDH4 | GGTTGGAGTGGCAGGAACGA | GAGAAACCTGCTGGGCCAGA |
| CDH5 | GCTCCGAGTCCATAGCCGA | GAGCCGTACAGCTCAGCCA |
| CDH6 | CTCCAACAGCTCGCGACA | GTGGTCACTGACTCCAGCGA |
| CDH8 | GTGGACTGGGAGACAAGCAA | TCATCAGCGTCGGTCGCA |
| CDH9 | GACGCAGACCCAAGTGCA | GGCCCCCAGTCACTGAGGTA |
| CDON | CGGTTCGAGTCCCAGGAA | GATGCCCACGGGTGGAGA |

FIG. 8 (Cont.)

| Gene Name | Forward GSP | Reverse GSP |
|---|---|---|
| CDSN | AGCAGCAGCTCCAGTTCCCAA | GCCCCCAGTCAGTGTCAAGGA |
| CEACAM1 | GCAACACCACCCTCAGCA | CAACCAGGGCCACTACTCCA |
| CEACAM6 | CTGGCCTCAATAGGACCACA | GAGCCACCCTGGCCAGCA |
| CEACAM8 | GCCCAGATGCCCCCACCA | GGTGGATTAGAGGCCGCA |
| CELSR1 | CTGTCCAGGAACCGGACACA | TCAGGAGGACGAAGGCCA |
| CELSR2 | TGAGCGGCTACAGCGGAA | TGTGTGGCAGACAGCCCA |
| CELSR3 | GCAGCCTTTCACAGCCAGCCA | AGGGGACGTAGAACAGGGGCA |
| CFH | AGGCGGGTGAGCAAGTGA | GGGCGGATTCACACAGGA |
| CGN | GATCGGGGAGGACTCTAAGCA | AAGTCGGCTCAGTCCTCCAGA |
| CHAT | GCTACAACCCCCAGCCAGA | TCTCAGTAGGCGGCAGCA |
| CHGA | AGGAGGAGGACAACCGGGACA | CAAGGCTGTCCTCCCGGGA |
| CHIT1 | CAGCCCTCTGAACCTGAGCA | GAGGATTGGGATAGAGCCCA |
| CHL1 | AAGCCACAGGGAGCCCCA | GACTGAGGGTCAGGCCCA |
| CHRNA3 | ACCCCTGCCAGGACGGGA | ACAAAGCAGAGAGGGACAGCA |
| CHST10 | CGACTATCCCTCCGGGCA | GGGCATACAGGCGTCGGA |
| CLCA2 | CATAAGCACCCCAGCCCA | GGCCAGCTGGAACTCCCA |
| CLDN12 | CCGGTATGACGGGAGCAGTGA | ATTGACCAGACACTTGGCCA |
| CLEC12A | AACCTCTCCACCACACTGCAA | GCTGGCATTCTGAGCAGCACA |
| CLEC14A | GAGAAGCTGGGAGAGACACCA | GAGGAGTCGAAAGCCTGAGGA |
| CLEC2A | CTGCGGGATGGCAGAGCTGA | ACTCCAAGCCAGTCCCCTGA |
| CLEC2D | GCATGCCCAGAAAGCTGGA | TCAACCTGAGCAAGATCAGCA |
| CLEC4A | TCAGATCCAGAAGGTCAGCGA | CAACGCAGCGCTCATTGGGA |
| CLEC4C | CTGCTGCCCAACCCCTTGGA | CACCACCAGATCAGCCCCCA |
| CLEC5A | TCAACACGCCAGAGAAACTGA | TAGGCCAATGGTCGCACA |
| CLEC9A | GGGATAGCCCAGCACCAGACA | CCTGCAACAACTTGACGCCCA |
| CLIP1 | CAGCCAAAGCCAAGGCCA | CCTGGCGTAACGGGAGGA |
| CLIP2 | AAGGAGAAGCGGCGCCTGGA | CTCCGCTCCTTCCGCAGCA |
| CLMP | AGGCAACGAAGCTGGGAAGGA | TTCGGATTAGCAGCCACACCA |
| CLU | TCATACGAGAAGGCGACGA | CAAGGAGGAGGTGTTGAGCA |
| CMA1 | CGGGCTCAGACACTCTGCAA | TCCTGGGATTGCCCACACA |
| CMKLR1 | ACAGCTGCATGAACCCCA | TAGAGCATTGACCAGGCGA |
| CNGB1 | GGCGCATGCTGAGAAGCA | TCCTGTCATAGCGAGGGCA |
| CNNM2 | GGTCACCGATCCCTACAACGA | TTCGCCGGTGATCATGAAGCA |
| CNNM3 | CCTGAGAACACCGACCTGCA | AGGGCTGCCTTCCACCGGGA |
| CNNM4 | CACTCGGCAGCAGTACCAGA | TCTCGTCCACCACAGGCA |
| CNR2 | TACGCTCAGTGACCAGGTCA | CAGGCAGTGATGGGCAGA |
| CNTFR | AGACCACGACCAGCACCA | TGATGGGGACGCTGACCA |
| CNTN1 | CCGCGTGGTAGCAACCAA | CTACATCTGAAGGAGCCACA |
| CNTN3 | GGAGACAGGGCACCTCTACA | CACCATCAGAACGTAGCACCA |
| CNTNAP1 | TGAGCCGGCCAGTGCCA | CGGGCACAGGCCGACCA |
| CNTNAP2 | CGCCTGGAGCTCTACAGCCA | GCTGGTGCAATGGCCCGA |

FIG. 8 (Cont.)

| Gene Name | Forward GSP | Reverse GSP |
|---|---|---|
| COL10A1 | ATGGAGAGGCTGGCCCAA | GCTATGCCAGCTGGGCCA |
| COL11A1 | GCAGGCCAAGATGGACCA | GACCAGGTGGACCTAAGGGA |
| COL12A1 | CAGAAGCCCCTACAGAGCCA | GTCCCCAATGCTCCAGGA |
| COL14A1 | CCAGGCGTTGGAACCCAA | CCAGGCTGGCCAGAAGGA |
| COL1A1 | CTGGCAAAGAAGGCGGCA | CCAGCAGGACCATCAGCA |
| COL1A2 | GAGGTCCTAGTGGCCCACA | GTGACCAGCGATACCAGGCA |
| COL26A1 | GGTCCAGCGCGTGTACCAGA | ACCGTCACCGTGCGGTAGGA |
| COL2A1 | GGACGAAGCAGCTGGCAA | CAGCCATCCTTCAGGGCA |
| COL3A1 | CAGGGCCTCGAGGTAACAGA | ACACCACCACAGCAAGGACCA |
| COL5A1 | CGGCCCTACTGGTGAACCA | GGGATCCCTCGAAGGCCA |
| COL5A2 | CTGGGCAACGTGGAGAGAGA | CAGGGTCTCCACGATCACCA |
| COL5A3 | AGGGGGAAAAGGGCCACA | CCAATGGGACCAGGGGGA |
| COL6A1 | CCAGGTGAATGAGCCCCA | GGTGGAAGACACCGCGGA |
| COL6A2 | GTGGTGCAGTACAGCCACGA | GCCCGTCCGTGATGACCA |
| COL6A3 | ACAGCGCTGAGACCACCA | CAACTGCCACTCTGGCGA |
| COL6A5 | GAAGAAGCAGCTCCTCCAGCA | GCTTGAACACGTTGCGGGTCA |
| COL6A6 | GAATGCCCAGTGCACCCA | AGGCGTCTGAGAAGCGCA |
| COL7A1 | TCGAGGCGAGAAGGGAGA | TGAGAGACGCGGAGCACA |
| COMP | TGATGCCTGCGACGACGA | CAGCGTTCTCCGGACACA |
| CP | CGCCGGAAATGAGGCCGA | GGCCACATGTGGAGCGTA |
| CPA1 | GGACCTACAGCCAGGGCA | TGATGGTCAGAAGCGCCA |
| CPD | CCTGGGCAGCATGAAGGA | CTGCCCACAAGGAAGGGA |
| CPM | GAAGCCGTCAAAAAGCCTGA | CATGGAGGTTTGCAGAGAGGA |
| CPQ | CAGGGCCATCATGGAGGA | CTGGCTCCAGGCACTCCA |
| CPZ | ACAGCTTCACGGGAGGCA | GGTGCACCGTCTCCACGA |
| CR1 | ATGTGACCCCCACCCAGA | AGTTCACAGCGAGGGGCA |
| CR2 | CCCTGGGCCAGAAAGAGGA | CATGTGAGCACTGGACAGCA |
| CRB2 | CATGGGACTGGGAAGTCAGCA | CCCACCTCCTACAGGATAAGGA |
| CREG1 | CACCATCTCCACGCTGGA | GCAGGTTGCTCACGGAGA |
| CRELD2 | ATCTGCACAGCCTGTGACGA | GCCGCACACTCGTCCACA |
| CRIM1 | CAGAACCCCTCACGCACCCA | CAGAAGGGCAGGACTCAGAGA |
| CRLF1 | CCGCTACCGAGTGGAGGACA | TGCAGCGCACTTGCACGA |
| CRLF2 | CACCAACGCCTCCCAAACCAA | GTATCTCAAAGAGCCCGGGGA |
| CRTAM | GTGCCTAACGTAACCCTGCAA | TCATGGTGGAGCACATGAGTACA |
| CRTAP | GCGAGGGTTCCAGGGAGA | GAGCAGATAGCTGACTGCACA |
| CSF1 | GGAGCACCAGGGATCGGA | CCAGCAAGACCAGGATGACA |
| CSF1R | GAAACCCAGGAGGCTGGAGA | CATCCCAGACCTGCAGCA |
| CSF2 | GAGCCGACCTGCCTACAGA | TTCCGGGGTTGGAGGGCA |
| CSF2RA | GAGCTCCTGGAGTGAAGCCA | GCCGAGGACGATGCCACA |
| CSF2RB | TCCAGAACGCCCACAGCA | CACAGAAGCGGAGGGCCA |
| CSF3R | CACGCCACCCATCACCAA | ACCAGAGTGGGGAGGCCA |

FIG. 8 (Cont.)

| Gene Name | Forward GSP | Reverse GSP |
|---|---|---|
| CSPG4 | AGTACGAGGTCCAGCGGGCA | CGAAGGCCAGCCGCCCTGAA |
| CSPG5 | CTGCGAGTCCATCATCACCGA | GAGCTCAGATGGGGTCCGGA |
| CTLA4 | GCTGAACCTGGCTACCAGGA | GCTGTCAGCCTGCCGAA |
| CTSD | GTGAGGCCATTGTGGACACA | CGCCCTGAATCAGCGGCA |
| CTSG | GCAGGGGAGATCATCGGA | CGCACCAGGAACCCTCCA |
| CTSK | AACCCAACAGGCAAGGCA | GGCTTGCATCAATGGCCA |
| CX3CR1 | CAACTCCATGAACAACCGGA | ATTGCGGAGCACGGGCCA |
| CXADR | CCAAAGAGCCGTACGTCCA | GTGGGAGAGTCGGACTCTGA |
| CXCL13 | GGACCCTCAAGCTGAATGGA | CAGAGCAGGGATAAGGGAAGA |
| CXCL16 | GGACCCATGGGTTCAGGAA | CTGAGTGGACTGCAAGGTGGA |
| CXCL5 | AGCCAGGGCCCATCGCCA | CCTTGGAGCACTGTGGGCCTA |
| CXCR1 | GCTCACCAGTCCCTCCCCAA | CCGACAGGGCCCTGTCTCCA |
| CXCR2 | ATCTACGCCTTCATTGGCCA | GTGCCCTGAAGAAGAGCCA |
| CXCR3 | CAGCTCTGAGGACTGCACCA | AGTGGGGCTCCAGGCAGCCA |
| CXCR4 | GCCAACGTCAGTGAGGCAGA | ACAGGATGACAATACCAGGCA |
| CXCR5 | GAGAACCAAGCAGAAACGCA | GATGTGGTAGGGTGACCAGCA |
| CXCR6 | CAGAGGCCATCGCATACCTGA | GTGAGACCCCAAGGTAAGGGA |
| CYBB | GGACGGCCCAACTGGGA | CACTCCCCGAGGGCCAGA |
| CYP27B1 | CCCCGAAGTCCAGACAGCA | TGACCACCGCCTTCAGCA |
| CYSLTR1 | CTGCCACATGCCATGACA | ATAGACCACACGGAGAGGCA |
| CYTH1 | GCCTGCAAGACCGAGGCTGA | GTAGAAAGGGTCCCTGCTGA |
| DAG1 | GGCTGCTCCCTGAACCAGA | CATGGATCTGCCTCCGGA |
| DBT | GCCTATGTGGGGAAGCCA | TCCATTGCCAGACGGCGA |
| DCBLD1 | GTTCCCTGTCAGACAAGCGA | CTCCCCCAAATCGATCTCCA |
| DCBLD2 | ATGTCAGGGCACCCCACA | GGCCTGGGCTGAGGAGCA |
| DCHS1 | GTCCATGCAGGAGGCACA | CAGGGTCAGGGTCAGCACA |
| DCN | TCTGGCCAACACGCCTCA | GTCCAGGTGGGCAGAAGTCA |
| DCT | AAACTCCAGGTTGGCCCACAA | CAACAGCACAAAAAGACCAACCA |
| DCX | GCCAGCTCTCTACCCCCAA | GTCATCCAAGGACAGAGGCA |
| DDR2 | CGAGATCTGGCCACACGA | CCCAAGACATCCAGCGGA |
| DGCR2 | CACCTGCCATGGAGGGGA | TGCCATCTGGGTCCAGACA |
| DKK3 | GATGGAGCCTTGGACCGA | GGACCTCTCTGGGCAGCA |
| DLL1 | GCTGCACGGATCTCGAGA | TGAAGCCGGAGTAGCCCA |
| DLL4 | GAGGTGCGGACATCCATCGA | CAAAGCCATAAGGGCAGTTGCA |
| DMXL2 | TCGGGGGGTAGGAAAGGACA | ATCTGCATGACTCCAGCCCCA |
| DNER | CACCAACATGCCACGGCA | AATGCGGCTGATGCGGCA |
| DNMT3B | CCCAAGCGCCTCAAGACA | AAGGAAGCGATCCCGGCA |
| DNTT | CTCAGGTTGCCTAGCAGGAA | ACGACGCTCGTAGGGGCA |
| DOCK9 | AGGGAAGCACCCTGGACA | ATCACAGCGAACCACGGA |
| DPEP1 | CCTGCACCAACAAGGCCA | GGGACCCTTGGAACACCA |
| DPP4 | TTGCAGTGGCTCAGGAGGA | CCAACCCAGCCAGTAGTACTCA |

FIG. 8 (Cont.)

| Gene Name | Forward GSP | Reverse GSP |
|---|---|---|
| DPP7 | CCTGACCTTCGCCAGCAA | CCCCAGAAGCTGGTCAGCA |
| DSC2 | AGGGAGAACATGTACGGGGA | CTCATCAGGATCAACCGCA |
| DSG2 | CTGCAGGGAAGCACAGCA | CGCAATGGCACATCAGCA |
| DSP | GACCAAGACATGGCCACCA | CCAGGAAGCGCTGGCCA |
| DYNC2H1 | GGCGCTAAGACCGGACAGA | GAAGGATCAGCACCCGGA |
| EBI3 | CCTGCTCCAAACTCCACCA | GTGACATTGAGCACGTAGGGA |
| ECE1 | CACACGCTCCTCACCCAA | CTTGAAGGCCTCCACGGA |
| EDNRA | AAGCAGCGTCGAGAAGTGGCAA | AGCAGCAGAGGCATGACTGGA |
| EFEMP1 | TCAGAAGCGAGGGGAGCA | CCCAGGACTGCACTGGCA |
| EFNA1 | TCACAGTCCTCAGGCCCA | CACAGTCCAGGCAAGTGGGA |
| EFNA4 | GCCCATCCCCCAGGAGGA | CACAGGGCACAGATGGCA |
| EFNA5 | CATGAGTCAGCCGAGCCA | ATCGCCAGGAGGAACAGTAGGA |
| EFNB1 | CCAGGAGTTCAGCCCCAA | GGCGTCACAGCATTGGGA |
| EFNB2 | CCGCTAAGGACTGCGGACA | CCGGGCTCTGCGGGGGCA |
| EFNB3 | CTGGGAAGGAGAACCTGCCA | CTCCGCCAACACATGGCA |
| EGFR | GGGGTGCAGGAGAGGAGA | TTTGCGGCAGACCAGGCA |
| ELFN1 | GCTACTCCTCCAGCCCCGA | TAGTCCAGGATGTCGTGCAGA |
| ELFN2 | CAGGAGCCGCCAGTCCCCAA | GGTTCAAGGCCCTCAGAGGA |
| EMB | AGAAGCACTCAGATGAGGGGA | TCACTGGCCCAGAGACTCA |
| EMC1 | CGCCCCGAGATCCCAACAGA | ACAAGTGGACTCCAGACCCGA |
| EMILIN1 | ACGGTCCCCTTCGACAGA | TGAGGCTGAAGACGCCCA |
| EMILIN2 | GCAGAGGTTGCAGAGCCA | CTGCCTGACACAGTTCCACA |
| ENG | CCGGGTCTCAAGACCAGGA | CCAGAGTGCAGCAGTGAGCA |
| ENO1 | CAACCCAAAGAGGATCGCCAA | GGCCAGCTTGCACGCCTGAA |
| ENPP1 | CACCGGCTCCTAATAACGGA | GTGAAGGGGCACTGTACCA |
| ENPP3 | TGAGCCATCCCATGCAGAGGA | TGCAGTACCCTAGGCCTCCCA |
| ENPP4 | TTGAGCCCAGTTGCTGCAA | ATTGTCCAGCCTTCATCGGCAA |
| ENTPD1 | CAAGATCCAGGGCAGCGA | AAGACATAGGTGGAGTGGGAGA |
| EPCAM | GAATGGCTCAAAACTTGGGAGA | GACCCCAGCAGTGTTCACA |
| EPDR1 | TGACCAAGCCACCAAGCA | GACCACTCCTGGACGGTGA |
| EPHA1 | ACTGCTTGCCAACCCCCA | GCCGAGTGGAAGTGCAGGA |
| EPHA2 | CTGTGCAGTGGATGGCGA | GCTCAGGGCACTCCAAGCA |
| EPHA3 | GTGAGCCATGCAGCCCAA | GTGATGCTGACCGCAGCA |
| EPHA4 | TCGGACAGCTGCCAGGAA | TGCCCGAGACAGAGACCAGA |
| EPHA5 | TCGAGCACGTACAGCAGCA | GCTGTAGCCACACCGCCA |
| EPHB1 | CAAAATGGTCCAGTACAGGGACA | CTGATGGCCTGCCAAGGTGA |
| EPHB2 | CATGGGCCAGTTCGACCA | GAAAGGAGTCCAGGGAGCCA |
| EPHB3 | CTGAAGGTGGGCTACACCGA | CCCGCAACATGCCCACCA |
| EPHB4 | GCGGCTAAACGACGGACA | GGATGTTGCGAGCAGCCA |
| ERBB2 | TGGCACAGTCTACAAGGGCA | GGAGCCCACACCAGCCA |
| ERBB3 | ATGAACCGGAGGAGAAGGCA | GTACAGGGTGGAGTGGGCA |

FIG. 8 (Cont.)

| Gene Name | Forward GSP | Reverse GSP |
|---|---|---|
| ESAM | TGGCCCAAGAGCTCAGACACA | AGGGCCTGGCTGGAGAGA |
| EVI2A | ATGCCCACGGACATGGAACACA | CTGTTAGCCCACAGACGGGTA |
| EWSR1 | GGAAACGTCCAGCACCGA | CCACGATCCATGAGGCCA |
| EXTL2 | ACACTCATCAGCACCCCAGA | GAATGAGGCTCCAATCAGCA |
| F11R | ACACGGGAAGACACTGGGACA | CAGCACTGCCCGGTTCCCA |
| F13A1 | TCCACCGTGCAGTGGGAA | GTCCAGCTCGCCATACACA |
| F2 | CGGATGCAGAGATCGGCA | GCTTGCCAATGCGCACCA |
| F2R | GCACCTGGCCACGGCAGA | AGCCCAGATGGCCAGACA |
| F2RL3 | GACGGACACAAACTAAGGGATGCCA | GTGAGGGAGAGCCCGTCCCA |
| F3 | GAGTGTGACCTCACCGACGA | CAGAGGCTCCCCAGCAGA |
| F5 | GCAGGGATGCAAACGCCA | TGGGCTCCCAGTAACCCA |
| FABP4 | TGGGCTTTGCCACCAGGA | CATGTACCAGGACACCCCCA |
| FABP7 | CTGGAAGCTGACCAACAGTCA | TTGAATGTGCTGAGAGTCCTGA |
| FAM171A1 | CCCAGCTTCCCTGAACGA | GGACCTGCCATCCAAGGA |
| FAM171A2 | GAGGCAACAGCACCGCAA | AAGAAGTCATCCCGGGAGGA |
| FAM174A | GGAGGGAAGGCCGGGGAA | TCATCCTGACCGTCCTGACCA |
| FAM174B | CCCTCAAGGCAGCCGTGA | CCGACCTGAAGACGCGCA |
| FAP | GTGGCAAGTGGGAGGCCA | CCTGGGCCGTAGCAGACA |
| FAS | TCAGAACTTGGAAGGCCTGCA | CCTTCTTGGCAGGGCACGCA |
| FASLG | GCCTCCACTACCGCTGCCA | CCCAGGCCCAATCCTACCAA |
| FAT1 | GAATTCCACCGAGGCCGA | TCACGACAACGTGGGCCA |
| FAT3 | GGAGATGCACAGCAGCGA | GACAGTCCAGCCCTGAGCA |
| FAT4 | GGCACTCTGGTAGGCACCA | CATTGAGGTCCCGCACCA |
| FBLN2 | GCTACACCATGACGGCCA | GAGGACACTCGAAGCGCA |
| FBN1 | TAACCACCGCTGCCAGCA | GATGTGAGCGCTGAGGCA |
| FBN2 | TGAGCTGTGCCCCAAAGACGA | AAATGCCTGGGCTCTCAAGACA |
| FCAR | CGCATGGCCGTGGCAGGA | CAGCTCGGTTCAGCCACA |
| FCER1A | GGTGGTGATGGAGGGCCA | CTCATAGTCCAGCTGCCACA |
| FCER2 | TGACGACATGGAAGGGCA | CCGAAGGCCAATCCAGGA |
| FCGR1A | CTGCGAGGCAGGAACACA | GGCCAAGCACTTGAAGCTCCA |
| FCGR2A | CTCATCCAAGCCTGTGACCA | TGGGCAGCCTTCACAGGA |
| FCGR2B | CTCATCCAAGCCTGTGACCA | TCAAGGCCACTACAGCAGCA |
| FCGR2C | AGCATCAGCCCCAATGCCCA | CAGCATGGAGAAGGCAGAAACCA |
| FCGR3A | AGCTGGCATGCGGACTGA | TCTCGAGCACCCTGTACCA |
| FCGR3B | CCCGGTGCAGCTAGAAGTCCA | CCCAACAAGCCCCCTGCA |
| FCGRT | GGCCCCAACAGTGACGGA | CGATGACGATTCCCACCA |
| FCRL1 | GAGGACAGGTGATGGAGGGA | TTGGGCGAGACACCGGGA |
| FCRL2 | CTACTCCTGTGAGGCCAACAA | AACAGTCCCCAGAGAACTCCA |
| FCRL3 | CCAGATCTGGAGCATCCAGCA | CTGCTAGCCTCCCCTGCAGA |
| FCRL5 | GCAGTGGCCTCTGACCCCA | TGAGGAAGCCAAGAACAGGGA |
| FCRL6 | CAGGTGGAGAGCAGTGCCCA | TCTCCCCACGGTGAACTCA |

FIG. 8 (Cont.)

| Gene Name | Forward GSP | Reverse GSP |
|---|---|---|
| FEZ1 | AAGCAGAAGGAGCAGCGAGA | TGAAGCGCTTGAGAGGCA |
| FGA | GGGGGCTCCTATGACCCAA | GCGAACAGCCCTGAGGGA |
| FGB | GCTCGTCCAGCCAAAGCA | GTAGGACACAACACCCCCA |
| FGF5 | CCTGGGCTCACGGGGAGA | GAGGAGGAGGCAGAAGAGGA |
| FGFR1 | CTGGACCAGTACTCCCCCA | GCAGCGGCTCATGAGAGA |
| FGFR2 | TCAACGGCAGACACCCCCA | CTCCCAGGGGCTTGCCCA |
| FGFR3 | CGCCAACTGCACACACGA | GCTCGAAAGGCGCCGACA |
| FGFR4 | GACCGGGTGTACACACACCA | ACAGCTCCTCCACCGGGA |
| FGFRL1 | GCCTTGGCGCCAACACCA | CAGGCTAGTGGCCGAGGA |
| FGL2 | TAACTATAATGGCACAGCTGGAGA | TACAGCCCACAGTTCCCAGA |
| FKRP | GACCACCGGCAGGATGTGGA | GGGCCCGAACTTGAGCTCCA |
| FLRT1 | TACAACCGGGGCAGCAGGAA | CTGCTGCCGTTGGAGGGGA |
| FLRT2 | TCCTGACTGGGATGGCAGA | CACGGTGAAGAGAGAGAGCCA |
| FLT1 | TCTGGCACCCCTGTAACCA | CACAACCAAGGTGCTAGCCA |
| FLT3 | TCGCAGAAGCATCGGCAA | TGCACAGCACTTGACCAGGA |
| FLT3LG | GCTCGGGACTCAGTGGGA | CATCTTGGACCCAGCGACA |
| FLT4 | CAACAAGGTGGGCCAGGA | CTTGGCAGCTCAGGAGCA |
| FN1 | GAGGAAATAGCCCTGTCCAGGA | CGGCCAGTGACAGCATACACA |
| FNDC5 | TCCACGTGCAGGCCATCTCCA | AGGACCACGACGATGATCAGCA |
| FOLH1 | ATGCTCCAAGCAGCCACA | TCTCTGCAGCTGCCTGCA |
| FOLR1 | CAGCAACTACAGCCGAGGGA | GCCCCACTCATGGCTGCA |
| FOXA1 | CCTGAAAGGGGACCCCCA | CGGGCAACGTAGAGCCGTA |
| FOXD3 | GTTCAGGGGGCGGCAGCA | GTGGCAGTCGTCCGGCTCA |
| FOXG1 | CTCGCTGGGCAACAACCA | AACTGGTCTGGCCCGCGA |
| FOXJ1 | CTACGCCACCAATCCGCA | GCGTGGCGGAAGTAGCAGA |
| FOXP3 | CATCCTGCCACCTGGAAGAA | CGGAACTCCAGCTCATCCA |
| FPR1 | TGCCACCAAGATCCACAAGCA | GGCCACCACCTGATATGGGGA |
| FPR2 | GCACCGTCTGGCTCAAAGAGA | CGTAAAGCATGGGGTTGAGGCA |
| FRAS1 | AGACACTTCAGTCCCCGGCAA | ATCCCCCCTTCTGGAACCCA |
| FREM2 | TGGACCGCACCAAGAGGCAGA | CGTGGTGCCTCCCACCACA |
| FSTL1 | ATCCAGTGGCTGGAAGCTGA | TCACTGGAGTCCAGGCGA |
| FUT1 | GAAGGGTGTGGTGGGCGACA | CCTCCTGTCCATCGCCAGCA |
| FUT4 | GAACTCGCAGCACCTGGA | GGGAGGAGGCACTTGGGAA |
| FUT5 | ACCCCGACTACATCACCGAGA | TGAAGGAGCGAGGCCGCA |
| FZD4 | TCCCCGCAGTGAAAACCA | ACGAACCCGGTGAGGGCA |
| G6PC | ACCCCCATCCCAAGTCGA | TAGGGGATGACACTGACGGA |
| GABRA2 | GCCAATCAATCGGAAAGGAGA | CACAGTTCTTGCAGGCACAGA |
| GABRB3 | TCGGGAGACCTTGCCCAA | ATACTCCAGAAGGGCCAGGA |
| GAD1 | GCTCTCTGACCACCCCGA | TGACCTGTGCGAACCCCA |
| GAD2 | GTGACGTGGAATCCACACAAGA | TGAAAGAGGTAGGAGGCATGCA |
| GALC | TGAGCCCTCCCACATGCA | CGCCCACAATCCAGGTCA |

FIG. 8 (Cont.)

| Gene Name | Forward GSP | Reverse GSP |
|---|---|---|
| GALNT1 | ATGCCACCACCTAAAAGGCA | GCAGTCTCTAATGCTGGGCA |
| GATA1 | CTGGGAGGCACAGGAGCA | CCCAGTAGGGGTCCAGGGA |
| GATA3 | CTCACTGGAGGACTTCCCCA | AGTGGCTGAAGGGCGAGA |
| GBX2 | CGGCGGCGGTAACTTCGACA | ACCGTCTCGGCCGCGGAGAA |
| GCG | GGACTCCAGGCGTGCCCAA | CCTCGGCCTTTCACCAGCCA |
| GDF15 | CCGTCGCAGTCGGACCAA | GCCCAGGTCTTCCAGCGA |
| GDF3 | AGCCATCCCTGTCCCCAA | AGATGGTCAGTGAGAAGGGACA |
| GFAP | TCGGGAACTCCAGGAGCA | GCATGTTGCTGGACGCCA |
| GFRA1 | GCACAGTCATGACCCCCA | ACGGTCACATCGGAGCCA |
| GFRA2 | GCTTCACAGAGCTCACGACAA | CAGGACAGACAGCACGGTCAA |
| GHRL | TGAGCCCTGAACACCAGAGA | CTAGAGCTCGGGGCTGCA |
| GLG1 | GCAGGAAGCCAAGGAGCA | GATCTGGCTCCAAGCGGA |
| GLMP | GGAGGTAGCCACATTGGGCCA | GAAGGCTCGGACAATGGGTGA |
| GNLY | CGGAGAAACTGCCCAGCA | AGCGAGGAGCCGGCAGA |
| GNPTG | CGAGTGGGAGATCGCCAA | GCTCGGACACATGGGCCA |
| GP1BA | GTGGGGTGCTCCAAGGGCA | TGGCTGTGGTCAGAGCAGCA |
| GP5 | ACTTAGCCCAGCGGCCTGCA | CATCCGCAGGGGAAGACAGA |
| GP9 | CCAGCTGCAGACCCTCGA | TGGGGCTGGCACAGCGGA |
| GPC1 | CTTCAGGCACGCTGGAGA | GGCCATCCCGTTCCAGCA |
| GPC4 | CAACCACAGCAGCTGGCA | GCTCGGAAGGGAGGACCA |
| GPC5 | CAGGCACTCAATCTGGGCA | CAAGGCTTAGTGAGCGCCA |
| GPI | GGGTGTGAGACACACGCCA | CTGGACCGGGATGAGGAA |
| GPM6B | TAAAACAACCGCTTGTGGCCGA | ATCCACACAGATCTGCTCCA |
| GPNMB | AGGGAGCATTCCCACGGA | CCCCAGGGTGAGGTTCACA |
| GPR107 | CCACCGAGGAGGGCACGA | AATGGAACAGCGAGTTTGAGGA |
| GPR132 | TGCCGGGTACTACTACGCCA | GGGCAGCGCTTAAGCCCA |
| GPR174 | CCACTCCTCAGAACCAGTGA | CATAACAACGGACTGGGCCA |
| GPR176 | ATGAGGAAGAGAGTGAGGCCAA | GTGCTCAGGGGTGGGGCA |
| GPR39 | TGCGGCCAAACCCAAGCACGA | GTCGGTGGTGGAGTGCGCA |
| GPR65 | CTGCAACCGGAAAGTCTACCA | ATGCAGCGAATCAGCAACA |
| GPRC5A | TCACGGGCTGGAAGAGACA | CCCAGCCATTGGCAGCCA |
| GREM1 | GCTGCAACAGTCGCACCA | GGGCTTGCAGAAGGAGCA |
| GRIA2 | ATGAGGAACAAGGCAAGGCTGTCAA | TCACGTAAGGGACAGCATGCA |
| GRID1 | GCTGTGACCTCACCAGCCA | CACCACAACTCCAGGGCA |
| GRIK3 | CAAAGCCCTGTCCACACGCA | CCATGCGCTCCACGGTCAGA |
| GRN | CTGCCGAGACAACCGACA | GCGGAAGCCAGCAGGACA |
| GTF3C1 | AGGCACAGCTCAGGCCAA | CAGACAGGTTCCGCACCA |
| GYPA | AAACGGGACACATATGCAGCCA | ATCAGTCGGCGAATACCGTA |
| GZMA | GAGGTGGAAGAGACTCGTGCA | CCCACGAGGGTCTCCGCA |
| GZMB | GCAGGAAGATCGAAAGTGCGAA | GTTACACACAAGAGGGCCTCCA |
| GZMH | GAGGAGATCATCGGGGGCCA | TCTCACTAGGATGCCGCCA |

FIG. 8 (Cont.)

| Gene Name | Forward GSP | Reverse GSP |
|---|---|---|
| GZMM | TCAGGAAGGTCACCGGCCGA | CACCCCACTGCACCCCTGGA |
| HAND1 | AAGAGAACCAGACGCAGGAAGA | GAACTAAACAGGAAGTGCAGCGACA |
| HAND2 | CCAACGTACCCGCCGACA | AAGGCCTCCGCCTCGCCA |
| HAVCR1 | AACCCACGTCACCTATCGGA | CAATATACGCCACTGTCAGACA |
| HAVCR2 | GGCAACGTGGTGCTCAGGA | CCGGCAGCAGTAGATCCCA |
| HEG1 | TGCAAGCGGAAGAGTCCCGAA | TCCACAGTTGAGACCACCA |
| HEPACAM | CCCCGGAGACCGAGGAGA | GGGCAGAGCGGATGGGCA |
| HEPACAM2 | TCACCATGATGCCACCCAA | CCGAGTGCCCCCTTCCACA |
| HES5 | GGGAGGGTGGGTGCCTCCA | GTCGTGCCCACACGCATCCA |
| HFE | CTGGATTGGAGAGCAGCAGAA | AGTGGTCACTGAAGAGGTCACA |
| HHIP | GAAAACAAGTCAGAGGACCAGCA | GAAGAGACGTTGCGAGCCA |
| HHLA2 | GAAGCCAGGAGGAGCAGACA | GCACTGGGACAGCGCTCA |
| HLA-A | CCCCACCCCCATGTCCACCA | AACAGGAAAGATGATTGGGGAGGGA |
| HLA-B | AGGCTGCGTGCAGCGACA | GCTAACAGGGACGCAGACACA |
| HLA-C | GTGCCTTCTGGACAAGAGCA | CAACGATGCCCATGATGGGGA |
| HLA-DOB | CTGAATGGGCAGGAGGAGA | CACAGAAACAGGGCTCAGCA |
| HLA-DPA1 | CTGGGAGGCCCAAGAGCCAA | TATGATGAGGACGGTGCCCA |
| HLA-DPB1 | GTGGAGCACACCAGCCTGGA | CTCCACAGATGATGAGCCCCA |
| HLA-DQA1 | TATGACTGCAAGGTGGAGCA | GAAGCACCAACTGAACGCA |
| HLA-DQA2 | AAGGTGCATCACCATCTACAGGAGA | GTCCCAGAGAAGAGGTGAGAGAAGA |
| HLA-DQB1 | CCAGCCTCCAGAGCCCCA | TGACGGATGATAAGGCCCA |
| HLA-DQB2 | GCGGAGCATCGAGGACTGGA | CCGCTGCAAGGTCGTGCGCA |
| HLA-DRA | GAGAGAGCCCAACGTCCTCA | GGAGATAGTGGAACTTGCGGA |
| HLA-DRB1 | ACAAGCCCTCTCACAGTGGAA | GATGAACAGCCCGGCCCCA |
| HLA-DRB5 | GTCCACAGGCCTGATTCAGAA | CCCCGACTCCACTCAGCA |
| HLA-E | CGCCAGGGACACCGCACAGA | AGCTCGCAGCCATGCATCCA |
| HLA-F | GACCGAGTGGCCCTGAGGAA | CTGGTGATACCCGCGGAGGA |
| HMCN1 | GGGGGACCAGACTCCCAGA | CACCTCCTCCACAGGAGGCA |
| HNF4A | GCTCGGAGCCACCAAGAGA | GCAGCTCCTGGAAGGGCA |
| HNRNPK | TCTCCCATCAAAGGACGTGCA | ATCCCACTGGGCGTCCGCGA |
| HP | GCTGACCAAGACCAATGCA | GGTACTTAGACATGCCAGCACA |
| HPX | CCAAGCCACGTGGACAGA | AGGTACAAGCCGGGACCA |
| HSD11B1 | CTGAAGCAGAGCAATGGAAGCA | ATGGAGGAGAAGAACCCATCCA |
| HSPG2 | GCAGAAGCGAGTCCCAGGGA | TCACGGTGTGGAAATGGCCCA |
| HTR1D | CAGTGCCCTGGAACGCAA | AGCAGGAGTCCCGGCAGA |
| HTR2B | CACCGGAAAAGGTGGCAA | AAGAAGGGACACCACATAAGCA |
| HYAL2 | CGGGGTACACCACAAGCA | CGCAGCTGGGGTTCACCA |
| IBSP | TGAATACGAGGGGGAGTACGA | GCCGGATGCAAAGCCAGA |
| ICAM1 | CAAGAACCAGACCCGGGA | GACACTTGAGCTCGGGCA |
| ICAM2 | CACAAACACTCAGCCCCGAA | GAGCAGGACAGATGTCACGA |
| ICAM3 | GTCCAGCTCACGAGGCAA | CGATAGTCACCACGCCCA |

FIG. 8 (Cont.)

| Gene Name | Forward GSP | Reverse GSP |
|---|---|---|
| ICAM5 | TACCTGCCCAAGTCACCAGA | CGCATTGGTGGCCACACA |
| ICOS | AAGGGGGGCAAATACTCTGCGA | GTAACCAGAACTTCAGCTGGCA |
| ICOSLG | AGCCGCTACCGGAACCGA | TGACGTTGAACAAGCGCA |
| IDO1 | GAAAGGCAACCCCCAGCTA | CTGGAGGAACTGAGCAGCA |
| IFI30 | CATGCACGCCAACGCCCA | AACTGGCAGACAAGGGTAAGGA |
| IFNAR1 | CCGCAGCCGCAGGTGGAA | GAAAAAGTCACATTCCCGACAGA |
| IFNAR2 | CCCGGAGTCCGAGGAGGA | TCTCACAGGGCCCACTCA |
| IFNG | CTGACTTGAATGTCCAACGCA | GGGATGCTCTTCGACCTCGA |
| IFNGR1 | AAAATACTCACGCAGAAGGAAGA | TCAGTTGTAACACCCCACACA |
| IGDCC4 | CTACCCGGACCTCCAGCCA | CAGAGGAGGAGACCGGGGA |
| IGF1R | CCAGGAACAACGGGGAGA | CCAGCTGTTGGAGCCGCA |
| IGF2 | CCGTGGCATCGTTGAGGA | GAACTTGCCCACGGGGTA |
| IGF2R | GACGACGGGCAGATGCACAA | GTAGAGCAACAGGGCCAGCA |
| IGFBP3 | CAAGTTCCACCCCCTCCA | CCGCTTGGACTCGGAGGA |
| IGLON5 | GACTGCTGAGCAGCGGCA | CCAGGGATCCTGGGCGCA |
| IGSF1 | GAGGCTCAGAGACAGACGGA | GGAACGGGCAGTTCCACA |
| IGSF3 | GGTTCTCAACCGCACCAGCA | AAGGTGGCGTCACGGCTCAA |
| IGSF8 | GGTGGAGCGACCAGAGGA | GTCGGCATGCTGCACCCA |
| IL10RA | CAGCTGCAGTGACCTGGGAA | CAGGCTAGAGATGAGGGGCA |
| IL10RB | AAAGCTGGGGAATGGAGTGA | GCAAGGCGAAGCAGCCGA |
| IL12RB1 | AGGCCAAGGCCACCAGGA | TGGTTCAGGCCAGGACCA |
| IL12RB2 | CTGCTCCAACTGGCCACA | GGGAGCACCGTCCAGGGA |
| IL13RA1 | CCCGAGGGAGCCAGCTCA | GTGCTACACTGGGACCCCA |
| IL13RA2 | AACAAGGGCATTGAAGCGAA | ATGCATGATCCAAGCCCTCA |
| IL17A | GCTGCATCAACGCTGATGGGA | GCCGGAAGGAGTTGGGGCA |
| IL17D | TCGCCCTGGGCCTACAGA | GACGGTGGGCATGTAGACA |
| IL17RA | GGCCGTCAGAAGCAGGAGA | GGCCTCTTGAAGTCCGGGA |
| IL17RB | GTGGCAAGAGCGAGGGCA | GGGGCAGACACTGAGAGCA |
| IL17RD | CTCCACTGCGCTACCGGGA | GTCTTGGTCCAGGCCCCCA |
| IL18R1 | GGCTGATATCCCAGGCCA | TCACTAGGCACACTACTGCCA |
| IL1R1 | CGTTGCAGGAGACGGAGGA | TCAGCCACATTCATCACGA |
| IL1R2 | CCCCGCATCAACCTGACA | TAGTGCAGACGTAGGTGCCA |
| IL1RAP | CGGGACCTTGAGGAGCCAA | GGCCGGAACCACAGCACA |
| IL1RL2 | GGACTTCACGGAGCAGTCACA | TGTGTGCTGCAGCAGCTGGA |
| IL21R | CCGGCCTGGATATGGACA | GTGGCGGAGGAATGACCA |
| IL26 | GCTGAGTGGGGTGAAGGGAA | AGACAGAGTGACTAACAGCAACCCA |
| IL27RA | AGAGGTCCCAAGGCACCA | CAGCTCACAGGGACCCCA |
| IL2RA | CACGGGAAGACAAGGTGGA | TGTTGTGACGAGGCAGGAA |
| IL2RB | GTCCTGAAGTGTAACACCCCA | GCGAGATCTCAGGTGCCA |
| IL2RG | CCGGACTGACTGGGACCACA | ACCACGGCTTCCAATGCA |
| IL3RA | CAACAGGCGTCAACAGTACGA | GAGAACCGCTGGAGAGTCGA |

FIG. 8 (Cont.)

| Gene Name | Forward GSP | Reverse GSP |
|---|---|---|
| IL4R | AGGAGGAGGAGGAGGTAGAGGA | TCCCAGGGCATGTGAGCA |
| IL5RA | AGCAAAGACACACTGGGGAGA | TCAATGGCGTGAAGGGCA |
| IL6R | TCCACCCCCATGCAGGCA | GGAGCGTTCCGAAGGCCA |
| IL6ST | GCGCTGTGGAGACGCGGA | AAACAAGGCTTGCACTAGCCA |
| IL7R | TAATAGCTCAGGGGAGATGGA | ATCGGGGAGACTGGGCCA |
| INHBE | GACCAAGGAGGAGGCGCCAA | GACTTCTCACCCCTCAAGCCA |
| INS | GCAGGTGGGGCAGGTGGA | TCCAGCTGGTAGAGGGAGCA |
| INSR | CGGTCAACGAGTCAGCCA | TGGACACCACTCCCAGGA |
| ISG20 | GGGTCACCCCTCAGCACA | CTTCAGGTCATGACCCACCA |
| ISL1 | CAGCAAAAGCGCAGGAAGAGAGA | CCAGCTACAGGACAGGCCAA |
| ISLR | GACAACGAGGTGCAGCCA | GCCTCAGGGTTCCCAGCA |
| ITFG1 | CCAACTCAGCCAATCCGCACA | TTCTCCAGATGGACGGGGA |
| ITGA1 | CAGGTGGGGATGGTAAGACA | TACGGCCACATCTCGGGA |
| ITGA10 | CAGAACCTGACTGAACCCCCA | CCCAAGGTGGCACCTCACCA |
| ITGA11 | GCTTGTTCCCCATCCACGGGA | TGCCCCAGATGTTACAGGA |
| ITGA2 | AGAGTTGCCCCGAGCACA | GGCTTCAAGGGCAGGGCTA |
| ITGA2B | GATGGACGCAGCCAACGA | CCCAGCTCACACAGCACCA |
| ITGA3 | CAGGCCATCATCCCCACA | GGATGGGGCACTCTAGCCA |
| ITGA4 | CGGAGCCAGCATACTACCGAA | CTGCATTGAGGTCCACAGCA |
| ITGA5 | GGGACTCAACTGCACCACCA | AAGCAGAGCTGCGGCTTGGA |
| ITGA6 | GGCTGCCAAATGCAGGCA | AAGCATCAAGATCCCAGCGA |
| ITGA7 | CATGCAGTCTGAGCGGGA | TGAGGAAGGCAGAGCCCA |
| ITGA8 | CAAAGAGGAGGAGGTTGGACCA | CCCGGGCAGAGAAAGGCCA |
| ITGA9 | GATGGCTGACGTGGCCAA | CGCTTCACATGGGCCACA |
| ITGAE | CTCATGCCCACAGAGGGAGA | CTCAGTGTAGCGGTCCAGGA |
| ITGAL | TGGCAGAGGTGTCCCGAA | ATGGAGGGGCTTCAGGCA |
| ITGAM | CTCGAGTACGTGCCACACCA | CAGCAGGGTGAACACGGA |
| ITGAV | GCAAGGTGAGCGGGACCA | CAAGCACTGAGCAACTCCACA |
| ITGAX | GAGGGACCTGCCTGTCAGCA | TCTGAGGAGCACCGAAGGGA |
| ITGB1 | ACCAAGGTAGAAAGTCGGGACA | CAATTCCAGCAACCACACCA |
| ITGB2 | TGAGCGCTACAACGGCCA | GCATACGTTGCAGCGGCA |
| ITGB3 | GGGGAGCCCTACATGACGA | CGGCAAGGCCAATGAGCA |
| ITGB4 | CGGAGGACCAGAAGGGCAA | GCACACACACTGTCCGCA |
| ITGB5 | TGGCCAGATCTGCAGCGA | TCCCAGAGTGGAGCAGCA |
| ITGB6 | ATCCCTCCTGCAGCGGAA | TCCAGCCGCTCCTGCACA |
| ITGB7 | ATGCGAGAGACACCGGGA | AGATAGGGGCCAAGGCCA |
| ITGB8 | TTCAGCAGCAGCCCAGCA | GTTCACAGAAGCGGCCGA |
| ITIH2 | AGAAGCCAGAGGCCAGCA | AGAAAGCTGTAGAGCTGAGGCA |
| ITM2B | GTGGACTGCAAGGACCCAGA | AGCTGGGGCATCTGCAGA |
| ITPRIP | CGCAAGGTGCCTGAGGCCA | GGTAGGCTGGTCTGAGGGGA |
| JAG1 | GGTGCCAAGTGCCAGGAA | GCAAGGTCGAGGGCCACA |

FIG. 8 (Cont.)

| Gene Name | Forward GSP | Reverse GSP |
|---|---|---|
| JAG2 | CTGCGACCAGTACGGCAA | CCGGGGTAGGGGACACA |
| JAM2 | TGACAAGAAGTGATGCGGGGA | ATGATGGAACTGCTGGAGCCA |
| JAM3 | CAGGTGTGAGGAGCAGGAGA | CCAACGTGATCAGGGCCA |
| JAML | GCCCGGAAGAGCCTCGAA | TATCAGAACAGGGAGCAGCA |
| KCNA3 | CGAGCTGGCCGAACGACA | GCAATCCCAGCTCCCGCA |
| KDR | GAGCCCAGTCAGAGACCCA | GGAAACAGGTGAGGTAGGCAGA |
| KEL | AAGAGGCTGTTACGGCACCA | CACCACGTGCACAGCGGA |
| KIAA1324L | TCCCAGTTCCAACAAGCCA | ATGCTCCGTACACAGAGGGCA |
| KIR2DL1 | ACCCCCGACACCTGCACA | GAGCACCAGCGATGAAGGA |
| KIR2DL3 | CAACGGAACATTCCAGGCCGA | AAACAAGCAGTGGGTCACTCGA |
| KIR2DS4 | CTGCCTGCTGGAGAGAAAACACA | GCAGCCTCAGGTAGACTAGGA |
| KIR3DL1 | CCAAGGTTCAGGCAGGAGAGA | GACCTTGCGCACTGCAGGGA |
| KIRREL1 | GGAAAGAGCAGCCAAAATCCCAA | TGGGTAGAAAATGTGACCACAGGGA |
| KIT | GTGGATGGCACCTGAAAGCA | AGGGCTGAGCATCCGGAA |
| KITLG | CAAAACTGAAGGGATCTGCAGGA | GCAAAACATCCATCCCGGGGA |
| KLRB1 | CCCACAGACTCAGGCCCA | TGCCAAGGTGAACCCTGACA |
| KLRC1 | AAACCCAAAGAGGCAGCAACGA | ACTATCGTTACCACAGAGGCCA |
| KLRC2 | GGTTTACTGCCACCTCCAGAGA | TAACACAGTGGCCATCAGGA |
| KLRD1 | CAGCATTTACTCCAGGACCCA | GAGAAGCACAGAGATGCCGA |
| KLRF1 | AAAGAAAAGGAGTTCTGCCCAA | AGGATCAAGGAGATCAAAGTCA |
| KLRG1 | CAGGAAATGAGCCTGCTCCAA | GGCACCGCATGTCTGCACAA |
| KLRK1 | GTCTCGACACAGCTGGGAGA | GCTACAGCGATGAAGCAGCA |
| KNG1 | CCGTGGGGAAGAGGAGCA | CACAGCCGAGGCAGTCGTA |
| KRT1 | CTGGAGAATGTGCCCCGA | CCGCCACCTCCAGAACCA |
| KRT10 | GGAGCCTCGTGACTACAGCAA | CTCCAGGTCAGCCTTGGTCA |
| KRT14 | AGGCCCCCCGTGTGGACACA | GAGGGGGTGAGGGTGAAGCA |
| KRT18 | GGCTCGGAAGAACCGAGA | TCCAGGTCGATCTCCAAGGA |
| KRT20 | AACTCCAGTCCCATCTCAGCA | CATCAGTTGGGCCTCCAGAGA |
| KRT5 | GTCCCAGATGCAGACGCA | TTGCGGAGGTCATCGCCA |
| KRT8 | GGCTGGAGTCTGGGATGCAGA | TGGAGCCCAGGCTGTAGCTGA |
| L1CAM | GGAGAGGATGTTCCGGCA | GAGGATGAGCAGGACGAGGA |
| LAG3 | GTGCCCAACGCTCTGGGAGA | AAGCCAAAGGCTCCAGTCACCA |
| LAIR1 | GCCGTCGGACAACAGTCA | TCTGGCGATGGAGGCAGA |
| LAIR2 | CCGCCTGGAGAGGGAGGA | GGAAGTCACTGTGCTCAGACCA |
| LAMA1 | CAGTGACACCTGTGACCCCA | GGCTGTGAGGACAGGCACA |
| LAMA2 | GTGGAGCTCACTGATGGGCA | AGCGTTGGCAGGCCACCA |
| LAMA3 | ACTCGGTGGCAGTCACCA | TGGCAGGTGGGAAGGGGA |
| LAMA4 | CCTGGACCCTGAGGACACA | AGTGGCCAGTTCCAGGCA |
| LAMA5 | ACGCGCAGAGCAACCACA | CAGAGCGAGTCATGGCGA |
| LAMB1 | GCCAGTGCGACAAAGCCA | GCAAGATGGCCCGAAGGA |
| LAMB2 | TCACACAGGGGGTGAGCA | GGCCTTCAGGACAGGGACA |

FIG. 8 (Cont.)

| Gene Name | Forward GSP | Reverse GSP |
|---|---|---|
| LAMB3 | CCGACACTGATGCAGCCA | TGGTCTGGGACAGCACCA |
| LAMC1 | TCACGTGACTGGCCAGGA | GCGCTCACAGTGCTGACCA |
| LAMC2 | CAGAGCTGGAAGAGAGGGCA | TGTAGCAGCCTGGGGGCA |
| LAMP1 | GAGCACGTCCGTGTCACGAA | GTCCAGCAGACACTCCTCCA |
| LAMP2 | TGCAGCTGAACATCACTCAGGA | GAGCAGTGTGAGAACGGCA |
| LAMP3 | GCCTCCAGTTGTCAGCCCA | TGATTGACACCTTAGGCGGA |
| LDLR | CAGCACACAACCACCCGA | AGCACGATGGGGAGGACA |
| LEFTY1 | AGGAGGGAGGCAGGACCA | CTCCTTGGCACGAGCGCA |
| LEPR | CTGTGGACAGAGCAAGCACA | TAAGCACTGAGTGACTGCACGA |
| LGALS3BP | ACCTCCCCACCATCCAGA | CGAAGAGCCCTTCGCAGA |
| LGR5 | ACATGCTCACGGGAGTCTCCA | TCACAGAGAACCCACGCTCCA |
| LIFR | GAAGCTGGAGGGACTGCACA | CTGCCCCTCCTACAGGGTCA |
| LILRA1 | CACCCTCAGCCCATCACA | GCAGAATCCCGAGGACCA |
| LILRA2 | CACCAAGCTCAGCAGAACCA | AGGGGGTCACTGGGGAGA |
| LILRA4 | CCACGGTGACCTCAGGAGAGA | ATCTCAGACGCAACGGGGGA |
| LILRA5 | CTGTGACCCCCAGCCACA | GAAGGTGTGAGGCAGTCCCA |
| LILRB1 | GACATCGACGTCAGGGCA | GAGTGTCCATCTCCACCCCA |
| LILRB2 | CCTGAACTCCCAGCCCCA | CCGGCTGCACTGAGAGTGA |
| LILRB3 | CCAGCTGCTGACGTCCAGGAA | TTCACCGGGGCATACGTCA |
| LILRB4 | CTACAGGGTCAGTCCCCCA | CTGACGCCAGTGTTGGAGGA |
| LIPG | CTGGTCTACACCGAGGAGGA | TGCGGGGTTGAGACAGGTA |
| LMAN2 | ACACGCCCGACGAGGAGA | GATGCCCAGGAGAGCGCA |
| LMAN2L | CACAGCCATTGTCCGCAA | TGATGGAGGAGGTGCCGA |
| LNPEP | GAACTCAGCCTACACCCGAA | CATGTGACCTGAAGAGCCTGA |
| LOX | CGGCATGGTGGGCGACGA | GCCACCAGGTCTGGGAGA |
| LOXL4 | ATGGACTGGCCCTACGGA | TCAGCCACCTTGGAGCCA |
| LPAR5 | CGAAAGGTCCGCCGTCACCA | GGGCGGAATCCTGGGGACA |
| LRFN1 | CAGTTCACCACCGCTGGGGA | AACGATGAAGACGAGGACCGA |
| LRP1 | AGGGCTTCCAGCACCAACGGA | CGTCCAGTAGGCCTCCCACA |
| LRP10 | CTCACTGCCCCTAGAGCCA | CATCTTCCAGGGCCAGGA |
| LRP11 | GCAGCCTACTCCACAGGAGGA | TTGCGGTCCAGGCCCAGA |
| LRP12 | TCAAGGACAAGGGCTTAGACAACCA | GCTCACAGGGGCCATCTCGA |
| LRP1B | TGGTCAGGCACACAGTGTGAA | ACGAGAGGCACAATGATGGCA |
| LRP2 | GGGAGTGCACAGAGAGCGA | GCCTGGCAGTATGCACCA |
| LRP4 | GTGCCAACCTCAACGGCA | CCAGGTTCTGCCACAGCA |
| LRP5 | GAGGAAGTCAGCCTGGAGGA | GTGGACTGGGCATGAGCA |
| LRRC15 | GCCTAGGTTAGGGACGGACA | GGGACATGGACGCTTGGAACA |
| LRRC25 | ATGTTTGTGGGCCAGCCAGCA | GCCTGGCCCAGTGACTGCA |
| LRRC32 | ACTCAGCTGCTGCGGCAA | GCACGTGGCTCAGGGACA |
| LRRC4B | CCGAGCTCAAATGCCGCA | GCGTGCCGTCATGCAGGA |
| LRRN1 | AGAATGTCCAAGGGGCAGACA | TCATGGACATCGACTGGGA |

FIG. 8 (Cont.)

| Gene Name | Forward GSP | Reverse GSP |
|---|---|---|
| LRRN4CL | GGTCCGCAGAGCCGAACTGA | GGATGTCGGCCCCCTCGA |
| LSAMP | ATGAGTGCAAAGCTGCCAACGA | ACTCAAAGTCAGGTGCAGGCA |
| LTA | GTATCCAGGGCTGCAGGAA | CTGAGGACTAGGTGGGGGA |
| LTB4R | GCCCCAGGAAACAAAGATTCCCA | CTTGTCAGAACAGAGTTGGACCA |
| LTBP1 | CGGAGCCAGAAGTGGCAA | GAGACAGCTGGGGTTGACCA |
| LTBP3 | GTGAACGAGTGCGAGGCA | GTTCAGGTCCACGCACGA |
| LTBR | AGCCACTGCCCCCAGAGA | GCGGACGCCTCTTGAGCA |
| LTF | GCCTCGATGGCAAACGGA | ATCCGAGACACCACGGCA |
| LTK | GAGTGCCTAAGACCCCCACA | GAGGGGCTTGAGGCCAGA |
| LUM | CTGCCCTGAAAGCTACCCAA | ATCTAGAATGAGCCACTGCAGA |
| LY6K | CTCCCAGCGAACGGACGA | CGCTGCACAACCAGCGGA |
| LY75 | AAAGCAGACAGACGTTGCAGA | TGAAGGAGCGCCTGCACA |
| LY9 | CTGAGGTGCACAAGCCCA | GTGACATATGGAGTGACGGGA |
| LYPD3 | CCACCAGGACCGCAGCAA | CCAACAGAAGGGCTGCCA |
| LYVE1 | AGGCGAACCAGCAGCTGA | ATCAGGACACCCACCCCA |
| M6PR | TGCTGGAGGACTGGACTGCTA | GTTGCCAGCTTCCCGGCACA |
| MAF | TGCCGCTTCAAGAGGGTGCA | CTCTCGCGCACCAGCCTGGA |
| MAFA | CTCAGGGGCCATCAGTGGGA | GGCGCGCCTTCCACTCCGA |
| MAN2B2 | GAAAGGCCATCGAGGGGA | TGCAGCACAGCCTCCAGA |
| MAP2 | ACCCCGACGACTCAGCAA | AGCAGTGACATCCTCAGCCA |
| MAP3K12 | CCCTGGACATCAGGGAGCA | CTTGCTCTCGCCTGAGCA |
| MARCKS | CCAGCGGAGGCGGCAGA | CAAAACCAGTACCTGGCACCA |
| MARCO | CCAGAAGGGAGACCAGGGA | GTAACCCAGCATGCGGCA |
| MBP | CCCTGCCCCAGAAGTCACA | GGTGTGCGAGGCGTCACA |
| MCAM | ACGTCAACGGCACGGCAA | GACCAGCTCCAGGAAGAGGA |
| MCOLN1 | CTCGCTCATCAATGGGGACGA | TGAGCGCGATGAAGAGGCTGA |
| MDGA1 | CTGCAGTGGACTCAGAGGGA | CGGGAGGCCATGTCACCA |
| MEGF8 | GCCGCAACTGCTCCACGGAA | GCCTCCGACAGCTGAACCCA |
| MELTF | CTCCACTCCCGAGATCCAGA | GGACTTGGCTGACACGCA |
| MERTK | CAGGTTGAAGCAGCCCGA | GGTTCCGAACGTCAGGCA |
| MET | TGGCCACGGGACAACACA | AAGTGCCACCAGCCATAGGA |
| MFAP3 | AACTGGATGGCAGAAGCAGA | TAGGGTGACAGAGTAGGAGGCA |
| MFAP3L | GATGACCAAGAGGGTGGACA | AGCTCGGTGGACGTGACA |
| MFAP4 | GGTCAGCGCAGAGGAGGA | GTGGCAGCTGCGGAACCA |
| MFAP5 | ATTCGCCAGCCAAAGTAGGA | GCAGCAAGAAACAGCAGCA |
| MFGE8 | GTGACAGGCATCATCACCCA | GTCCCAGTTGCCAGGGAA |
| MFSD4B | TTGAGCAACATTGGCAGCCTGA | TTCTCCCAGGGAAGCACCA |
| MIA3 | CACAGGCTGTCAGCTGCAGA | CAGCACGAGCTTTGAGCCA |
| MICA | CGAGGCCTCAGAGGGCAA | TTCCCATCAGGCAGGACA |
| MICB | GAGCCACAACACCCAGCA | CACCAGCGCCTTCCCAGA |
| MILR1 | CCAGGGACCGTGGAGACACA | TGTGGAAACACACGGCCTGGA |

FIG. 8 (Cont.)

| Gene Name | Forward GSP | Reverse GSP |
|---|---|---|
| MIOX | CGGGATGTATCAGCCCCA | GTGTGCCAGGGGTAGAAGGA |
| MIXL1 | ACTGCCTGCCCGAACCAA | GTGTTCCTCCCATGAGTCCA |
| MME | CATAGGACACGAAATCACCCA | ACCTGCCAGGTCCCAGGA |
| MMGT1 | CCAAATACTGTGCAGCCGCAGAA | TCAAGCCACTGAGAAGCCACA |
| MMP13 | CTGAGAGGCTCCGAGAAATGCA | ACCCACATCAGGAACCCCGCA |
| MMRN1 | ATGTCCCAGGTGGGAAAGGA | CGGCCCACTGTATCCAGGA |
| MOXD1 | CACGAGTGCTATCACCCCAA | CCAGCCTCAATCACCCCA |
| MPIG6B | ACCTGGACCAGGAACCGA | CTGCATAGATGGTGGAGGCA |
| MPL | CTAGGGTGGAGACCGCCA | GTCTGGAAGTGAGGGCCACA |
| MPPED1 | TGCTCAACACGGTGCAGA | CACAGTGCATACGGACGCA |
| MPZ | GCCAGGAAAGGACGCGTCGAA | ATCCTTGCGAGACTCCCCCA |
| MPZL1 | TCCACTACTCCCAAGGGCAA | GTGTCCAGGCTGGACAACGA |
| MPZL2 | CAGGTGAAGAACCCACCTGA | GCCAGAGCCAGGAAGTGGA |
| MR1 | ACCTATCAGGCGTGGGCA | TGACAAGGACAATGGACCCA |
| MRC1 | GACGACTCCCGAACCCAA | TCCACCCAGAGCTCGACA |
| MRC2 | TACCATGGCAGCTGTCCCCA | AGGATAGACAGGACGGCCCCA |
| MRGPRF | TCAACCACGTCATCCTGGCCA | CCCTGAGCGGCTCCCACA |
| MS4A1 | AGAGCCAATGAAAGGCCCTA | CCCCAGAGAGGGTACCACACA |
| MS4A2 | CTCATCCCCACCACTGCA | TACAGAGCAGACAACTGTTCCA |
| MSLN | GGAAGGGGCCAGCTAGACA | CGGGCCTTGGGATAGAGGA |
| MSR1 | GGAAGCCAACCTCATGGACACA | CCATGTCCCTGGACTGAGGAA |
| MST1R | TGAGAGCTGCCAGCACGA | CCAGTGCAGCCACAAGCA |
| MUC1 | GTCCACGACGTGGAGACACA | CGGCACTGACAGACAGCCA |
| MUC16 | CAAATGGCCAGCACAATCCCCA | GCTCCCAGGCTGGTAGCCA |
| MUC4 | CTTGAGCCTCACGACGCA | AGAGCGCGATCACCGAGA |
| MXRA5 | CCACTGTGCGGGAGATAGCA | GCAGAACCACACCCTCGGGA |
| MXRA8 | CCAGGCCCAGACCCCACA | GCGGCCAGGAGGACAGTGA |
| MYH1 | TTACCCGAACCCAGGCCA | CAGGGCCAGTGCTTCACA |
| MYH10 | CAAGAACCGCCTGCAGCA | CGGCATAGCGAGCAGAGA |
| MYH11 | GAAAGCAACGTGCCCTGGCA | CATCTCTGGAGGCACGGGCA |
| MYH6 | GGCAGAGATCGAGCGGAA | TCTGCAGCGAGTCCACCA |
| MYH7 | TGCCACCCTGGAGACCAA | TCCTCCTGCTCCAGCACA |
| MYH9 | GCCCAAGCAGCTGAAGGA | ATCCTTCCACAGCTCCGAGA |
| MYL3 | AGGACACAGGCACCTATGAGGA | GTGGCCAGCACGTGGCGA |
| MYOCD | AAAGCGGAGAAATGCCAGCAGA | AGCCGAGGGCTTGGTGAGGA |
| MYOD1 | CCAGTGCACTCCGGTCCCAA | AAAAGTGGTCCTGAACCGGGAA |
| MYOF | AGATGAGCCTCCTCCTGAGAGA | AGAAGGTCACCCACCGGA |
| NAGPA | GCCCCTCTAACTGCAGCCA | ATGCCAGCCAAGGGGACA |
| NANOG | CCACCAGTCCCAAAGGCA | ACACACAGCTGGGTGGAAGA |
| NCAM1 | GGCAGTGAGTCAGAGGCCA | CATCACACACAATCACGGCA |
| NCAM2 | GCTCTCCAGAACCCGCCA | TGGCCCTGCAGACATAAGGA |

FIG. 8 (Cont.)

| Gene Name | Forward GSP | Reverse GSP |
|---|---|---|
| NCLN | GCTGACAAGCGGGACCCAGA | AGAGGAGGCTGAAGTGCTGGA |
| NCR1 | CACCAGCCTTGCACCTGAAGA | CTGGGCAGTGTGATCCCAGA |
| NCR2 | AGACAAGCCCCTGAGTCTCCA | CTCTTGGCTACGAGGAGTCCA |
| NCR3 | GCACATCCGGGACGTGCGA | CTTTCTCCACCACCAGCCGA |
| NCR3LG1 | GCCTTGCGAGACAACCCA | GCTGGAGGAGGTTCCCAGA |
| NCSTN | CCGAGAGCAGTGCCAGGA | AATCGTGCAGTAGAACGCACA |
| NECTIN1 | CAACTGGTACCTGCAGCGGA | CCTCCACACCCTTGGGGA |
| NECTIN2 | CCTGGTCCCATGGAACCA | CCGCCGTGAGATGAGGGA |
| NECTIN3 | CAGATTTGCTAGAGGAAGGCGA | ATCCAACCTGCTCCACACAGA |
| NEFH | GCCTCCTACCAGGAAGCCA | GGGAGTCCTTCTGGAAGCGA |
| NEFL | TCACCAGCGTGGGAAGCA | GGCTGGTGTAGTAGGACGGGA |
| NEGR1 | ACCAACGTGACACAGGAGCA | GTTAAGAGGCAGGCTCGCA |
| NELL1 | GCCACTCACTTGCCCCAA | TGCAGGGAGATCCAGCCA |
| NEO1 | CAATCCGTTCGAAATACCCCCA | TTCAATGGGTGGGAAGGGCGA |
| NEU1 | CTCCAACCCAGCACATCCAGA | CCTCCAGGGTTGCCAGGGA |
| NEUROD1 | ACACGAACCGTCCGCCGA | ATGGGGATCTCGCAGCGA |
| NEUROG2 | CTGGGAAGAGATGATGGTGGCA | TCGGCGTTAAAGAGAAAGGGGAGGA |
| NFASC | CGGGACACCCAGATCAGCA | ACCATCGCAGTGTGGGGA |
| NFATC4 | CTCTGCCTCGGTCTGAGGA | AATCCGGGCCTTGGACCA |
| NGFR | GCTACCAGCCCGAGCACA | ACTGCACAGACTCTCCACGA |
| NID2 | GGGAGCAGAGCCTGAGACGA | TGGCACGGGGATTCACCA |
| NKX2-2 | ACGCCGGCAAGAAGCGAA | GGCGGATGAGGCTGGCCA |
| NLGN1 | AATACCAGACGACCCCCAGA | TGACGGTCAGCCCAGTCA |
| NLGN2 | CACCAATGGGTGGCACCA | TGACCACGGCACTGAGCA |
| NLGN4X | TCGCTGCAGGCACACGACACA | GCAAAGGCTGCATCCCCGTCA |
| NMUR1 | GCACCTGGCCTTCCAGCA | TCTGAGGCGATGGCAGCA |
| NOMO3 | GAGATCCACGGGAAGGCA | GGGGCCAACACTGTAGGCA |
| NOS3 | GTGCTGCGGGATCAGCAA | CTGACGCTCCTGCAAGGA |
| NOTCH1 | CACAGGACCCAACTGCGAGA | CACAGGCACACTCGTAGCCA |
| NOTCH2 | CCCATTGATCGACGGCCA | CCTCCTCGGAGAGAAGCCA |
| NOTCH3 | TGCAACCCGGTGTACGAGA | CTGGCACAATCCAGCCCA |
| NPC1 | CCTCTGACTCCGGAAGGCA | TGGTGCCATGGCCAAGGA |
| NPHS2 | CAAAGACAAGCCAAAGTGCGGA | ATCGAAGCTGAACGGCAGCA |
| NPPA | CCTGGACCGGGGAAGTCA | CGCAGGCTCCGAGGGGCA |
| NPR1 | CTGGACCCAGAGCAAGGACA | TCCACGTGGAAGACCCCA |
| NPR2 | GGTCAACGCCATGCACCA | AGGCCAACAACCCCAGCA |
| NPR3 | CATGGCATGACCAGTGGAGA | GTGACTGTCTGGAGGGACGA |
| NPTN | TGTCAGCGCTCCTAAAGCA | GGTGGGGGTAGCCAACTGA |
| NPTX2 | AGGACGGAGAGAAGCTGGGCA | TGGCATCAAACCTACCCCCCA |
| NPY1R | AGTACAGGTCCAGTGAAACCAA | GCTGTGAGGTGGCAGAGCA |
| NRCAM | CTGTCATGGACCCCAGGCGA | TGTTCACTGCCATCACGCGGA |

FIG. 8 (Cont.)

| Gene Name | Forward GSP | Reverse GSP |
|---|---|---|
| NRP1 | GGTGGGAAGCACCGAGAGA | CGCGTGGAGAGAGCTGGA |
| NRP2 | ACCGAAGAGGAGGCCACA | CACAGGGCTCCTCGAGGA |
| NT5E | CGTGCACCGCTACGGCCA | GAGAGGGTCATAACTGGGCA |
| NTM | TAGCCTCACCTGCATAGCAA | GCCACGTCATTGGAGGCA |
| NTN3 | CGACCCGCGACGGGCACA | GCAGGCTCACGAAGACCA |
| NTNG1 | ACTGCCAGAACGGAGGGA | GCCAGAGTCGGAGCCGCA |
| NTRK1 | ACTGAAGGAGGCGTCCGAGA | CCCTCGGTGCAGACGCCGAA |
| NTRK2 | CGAGAGCCCCACATGAGGA | GAATGTCCAGGTAGACCGGAGA |
| NTRK3 | AGACCTGGCCACCAGGAA | TCAGGAGGCATCCAGCGA |
| NTSR1 | TCTTCTACGTCAGCTCCACCA | TCCTCCTGCGCCGCCACA |
| NUP107 | GAGGCAGAGGTGACACGGA | AATGAGCTAGGAGTTCGAGGGA |
| NUP210 | TCCTCCACATCGACCCCA | TCTGAGGGACGCTGACCA |
| NXPH4 | CACCAAGAGGAAGCCGTCCA | TTGCCGGTCACCAGCAGCGA |
| OAS3 | AGCTACAGCAATGCGGGCGA | ACCAGTGCTTCACCAGCCGGA |
| OGN | CACCTTCCTCTACTTGGACCA | CTTCAATGCGGTCCCGGA |
| OLFM1 | CCATCCTCAAGACCCGCA | TGGCGTACACGGCCCACA |
| OLFML2A | CAACCAGCAGGAAGGCCA | GCTCGTTGAGGAACGGCA |
| OLFML2B | GCGGACCTGAGCACACAGA | CGAACAGCAGCCTGGGGA |
| OLFML3 | CCTGGCAGCTGATGAGGA | GACGACATAGAGGGTCCCACA |
| OLIG2 | CATGGATGGCCTCCGCGA | CGCTTCATCTCCTCCAGCGA |
| OLR1 | TGAAGGACCAGCCTGATGAGA | AGGAGGTCAGACACCTGGGA |
| OPCML | GGAACACCAATGCCAGCA | AAGAGGGTCCCTGATAGCCA |
| ORM1 | CGTGGGAGGCCAAGAGCA | GCATAGACAGACAGCCCCCA |
| OSCAR | CAGTACCGCCACTCCGCGCA | CAGCACGTAGGGCGCGGA |
| OSMR | AACCCAGTAGAGGCACCACA | TCTCGGTCGGGGGAGGCA |
| OSTM1 | CTTCGGCAGCAGTCCGCACA | TCCGGGGGCAGCGACAGA |
| OTX2 | TTCCCGGACCAGGGGCCA | TAAAACCCAAGCTTGAAGCTCCA |
| P2RX7 | GGGCCTGCATCACCACCTCA | GGAATCCACATCCAGCGCCA |
| P2RY10 | AAGGGATCAGTGAGAGGCAGA | ACTTGCAAGGCACAGGCA |
| P2RY11 | ACATAGCCCAGGCCACAGCA | GGGGCAGTGTCGGCAGCA |
| P2RY8 | GCTGTTGCGCACGGAGGA | TGTTGAGGCAGCTGAGACA |
| P3H1 | GCTGGGGCAAGAAGGCAA | CGATGGCAGTGCGGCACA |
| PANX1 | GAAGAACTCACTGCAGAGCGA | ATGTCAAGGTCACGCGCA |
| PARM1 | AGACCACCACCACCTTTCCCA | TAGGTAGGCTGCAACTCCA |
| PCDH1 | CCTGCCCCTCAACTACCCA | GCAGCTGGATGGAAGGCA |
| PCDH15 | TCCAGAGGCAGTGACCAGCA | CAAAACCACCAAGATGGCAGGA |
| PCDH17 | CCTCCCCTCAACTCCACCA | GGATCCTGGGCGAGCACA |
| PCDH18 | CCAGCAGCAGCATCCACA | CCGATCCACCTCACTGCA |
| PCDH19 | TGTGACCATCTGCAGCCCCAA | CACGGAAGGCTTGGTGGGCA |
| PCDH20 | CAGCGAGGAGAGAGGCCAA | CCAACACTGTGAGGGCCA |
| PCDH7 | CACATCCCACTCACCCAGGA | ATGCCAGCAACCACGCCA |

FIG. 8 (Cont.)

| Gene Name | Forward GSP | Reverse GSP |
|---|---|---|
| PCDH9 | AGTCCTGACCTGGCCAAGCA | GGGAACTGCACTCTGAGGCA |
| PDCD1 | CCTGAAGGAGGACCCCTCA | GCTCAGGGACACAGGGCA |
| PDCD1LG2 | CCACACCGTGAAAGAGCCA | TAGTCCCAGGCGACCCCA |
| PDE6B | GAGACGACCCGGAAGGAGA | CTCCCAGAACTCAGCAGCCA |
| PDGFRA | TGGGTACCGGATGGCCAA | CAGGCAGCAGATTCTCCACA |
| PDGFRB | TCAGCTACCAGGTGGCCAA | CAGAGCAGGATCCCGAAGGA |
| PEAR1 | CCCCTGATCCATGACCGA | GGATGCCGTACTGGAGGCA |
| PECAM1 | GACTCACCTGGCCCAGGA | TGCCACTGTGCTCCACCA |
| PI16 | TCCTCCAAGTCCCTGCCCAA | TCCAGCCAACACCAGAGGA |
| PIEZO1 | CAAGTACATCCGTGCCCCCAA | TCCTGCAGCTCGATGACCCA |
| PIGT | CTGGTGAACCTGCCGACA | GTGGAAGGTTCGGGTGAGGA |
| PILRA | CAGCACAAGGCCGCCTTCCA | TGTGTCCAGCTCAACTCGGCA |
| PKHD1L1 | AAGGTGACTGCCCAGCCA | ACCGAAGGCTGCTGAGGA |
| PLA2G3 | TGCGGAGGCTTCAGCAGA | CCTGGGTTAGCTGCAGGCA |
| PLA2G6 | GGCCAAGGAACTGGGCAA | CCCAGAGGGCGTTGACCA |
| PLA2R1 | GAGCCGGTGCAGTACACACA | GGCTGCTTGCACAAGGACA |
| PLAT | CCATCCAGCCGCTGCACA | GCGGCCATCGTTCAGACA |
| PLAU | GGTGATCAGCGCCACACA | AACGGATCTTCAGCAAGGCA |
| PLAUR | CAGGACCCTGAGCTATCGGA | CGAGGTAACGGCTTCGGGAA |
| PLBD1 | GGCAAGAGGTGGGCAGACA | GGAACATTGTAGGAGGGCCA |
| PLPP1 | AGGCAGACTGCGGCCTCA | CAAACAGCATGCAGTACATGGA |
| PLPP3 | CAAAGTCCAGGAAGCCAGGAA | CTATGCAGCAGGCCACCA |
| PLTP | GAGGTCCAGCTGTCCAGCA | TGGGATCAGAGCCAGCGA |
| PLVAP | ATCAGAAACTCAGCCCTGGACA | CTCCAGGCTAGCTGGGTCGA |
| PLXDC1 | CAGAATCTCGGCGAAGGAGCA | ATGCTGCAGGCAGGTCGGCA |
| PLXNA1 | TGACGGTCACAGGCACCA | CACAGGGTTGGCCACAGA |
| PLXNA2 | GCCCCGATGATCACCCCAGA | TGTACTTGATGGCCAGGGGGA |
| PLXNA3 | AGGCTCAACTCACTGGCCCA | CTCTCGTAGCGGCTGAGGGA |
| PLXNA4 | GGAGGGACCCAAGTGACCA | TGTCCACCTGCACCGACA |
| PLXNB1 | CCAAACTGCCATGCCCCA | CAGTCAGTGGCTCCACCGA |
| PLXNB2 | CCCACGATGCCAACGAGA | CAGGGCCTCATACACGCA |
| PLXNB3 | TGAAAGCCACCGAGGAGCCA | GGTACTTGACGGCGATGGGGA |
| PLXNC1 | GCGAGCTCCGGAAAGAGA | GAAGCCACCTGACTCAGGGA |
| PLXND1 | GGGAATCTCCGACCCCGACA | GTCGATGAAGGCCTGCGCGA |
| PMCH | TCTGCCACTGAATCTGGCTA | CTTGCCAACAAGGTCGGTA |
| PMEL | CATGGGTACCACACTGGCAGA | GGACCTTCAGGCTCAGGGA |
| PMEPA1 | GCAACACGAAGCTTCCAGAACCA | CACAACAGCCATGGAATCAGGCA |
| PODXL | GCCGAGCAGTCAAAGCCA | GTACACATCCTTGGCAGGGA |
| PODXL2 | GCATATGCCTCCCAGAGAGGA | GGGATCCATTCACAGGGAGCA |
| POMC | AGGCCGACCTGGAGCACA | GCGTCTGGCTCTTCTCGGA |
| PON1 | GTGAACCATCCAGATGCCAA | TAAAAGTGCTCAGGTCCCACA |

FIG. 8 (Cont.)

| Gene Name | Forward GSP | Reverse GSP |
|---|---|---|
| POSTN | CAGCAAACCACCTTCACGGA | TTAAGGAGGCGCTGATCCA |
| POU3F4 | TGCACAGGGCCGCAAGCGCA | AGGAGATCTCCTGCGCGGCA |
| POU4F2 | CGCGCTGGCCAACCTCAAGA | CTCGAGCCATGCCTGCAGGA |
| POU5F1 | AGGAGCTAGGGAAAGAAAACCTGGA | CCCAAACTCCCCTGCCCCCA |
| PPY | CAATGCCACACCAGAGCAGA | CCCACTCCGAGAAGGCCA |
| PRELP | CCTGGAGAACGTGCCACA | TCATGAGGTCCAGCGGGA |
| PRF1 | ATCTCCAACTACGGCACCCA | GGCCTTGGCTTCGGCAGA |
| PRG2 | GGAGGTGCTACAGGGGCAA | AGCGACCCGAGCCTGTGA |
| PRNP | CAGTCAGTGGAACAAGCCGA | CCCAGCATGTAGCCGCCA |
| PROCR | CTCGGTATGAACTGCGGGAA | GATGCCTACAGCCACACCA |
| PROM1 | GACCAAAGAGGCGTTGGAGA | ATGGATGCACCAAGCACAGA |
| PROM2 | GAGGAGGTGACTCAGCGCA | TGCACCATGCCAGGCAGA |
| PROX1 | GCCGAAGCGAGAAGGCAA | GAGGTGGGAAGACCTGAGGA |
| PRSS23 | GTGAGCCCTCCTGCTAAGCA | ACATCCTCACATAGACCCCAGA |
| PRSS35 | GGAATCAGCCCAACGATCAAGA | GGATTCGTCGGACACACTGCA |
| PTAFR | CCAACACAGTGCCCGACA | CCGTGCACACCATCCACA |
| PTCRA | CACAGGCCTGGTGCTCAAGA | TGTGACGCAGGGGAGGTAGA |
| PTGDR | CAGCAAAAAGCCCACCCAGGA | CGTCTCCACGGACAGCAGAA |
| PTGDR2 | GCCACAGCAACACCAGCA | TGCGGCAGCCCACCACGA |
| PTGER2 | GAGGAGACGGACCACCTCA | CAGGAGGCCTAAGGATGGCA |
| PTGER3 | GGGCCAGTACACCGTCCA | GGTGGCCAGGTTGCAGGA |
| PTGFRN | CTGGCAGAAGGAGGCAGAGA | GACAGGACAGGAGCCCGA |
| PTGIR | GCGCACCGGAGAGGACGA | GCGTAGAAGCGGAAGGCA |
| PTK7 | CCCCTCAGCACCAAGCAGA | TGAGGCCCAGGGCAGACA |
| PTPRA | AGTCAGGGAACCACCCCA | CTGCACCACCTTGTAGCAGA |
| PTPRB | AAGTCACAGCGGAGAGCAGA | CCACGTGATGGCCAAGGA |
| PTPRC | CACCAGCTGGCCAGACCA | GTGCGCCCAACACCAGCA |
| PTPRD | GGGAGCATGGAGAGGAGCA | ACCCAGGCCTTGAGGGGA |
| PTPRF | AGACCCTGCCACGAGCAA | GTAACGTGTGCCTGCCGA |
| PTPRG | GATCCCAAGAGGCCCGAA | GAGAAGGATGAGGCACACGA |
| PTPRJ | CAGCGAATGGCACAGAAGGA | ATGACAGCGCGAGGCTCA |
| PTPRK | CAAGAGAGAAGCCGGAGCCA | CCCACAGTGAACGGGGCA |
| PTPRM | CGATGGGGAGAGCAGCAA | GTGGACACAACTGGGCAGGA |
| PTPRQ | GGCCAGAGGACAACAAGCCA | AGGAACCCCATGCTCTGGCCA |
| PTPRS | CAGTTCACAGACTGGCCGGA | CCACGCCTTCATACCGCA |
| PTPRZ1 | GGAGGAGTGACGGCAGGAA | TCAGGCAATGCTGCACCA |
| PTTG1IP | GGCCGACGCCGTACTGGA | AACTCCCCAGCGTGCAGA |
| PVR | AGCAACCCAGAGCCCACA | TGGCGAGCTCCTAGGGCA |
| PXDN | CTGTGACGCCTCAGGACAGA | CAGTCAGGTGGGCCACGA |
| QSOX1 | CGCTAGCCACTTCGAGCA | ACGTCCCACACGGGCACA |
| QSOX2 | CCAGGGGTGAGGAAGAGGAGA | GGCTGGAGAAGTCAACCCCGA |

FIG. 8 (Cont.)

| Gene Name | Forward GSP | Reverse GSP |
|---|---|---|
| RAB5C | TCCAGGAAGCACAAGCCTA | GGTTTCGGCCTGGAGCACCA |
| RAET1G | CCACCCTCAGTCCCTGCA | GCGAGTCACGTGTCCACCAGA |
| RAMP3 | CACCGGCATCCACAGGCA | CCAGGCCAGCCATGGCGA |
| RCVRN | CCCAGCATGTGTTCCGCA | CCGTCCACGTCGTAGAGGGA |
| RECK | TATCAACTCTGACAGCCCGA | GTCCAGAGCAAGTGCAAGGCA |
| RELL1 | AAGTCCAGAGAGAGCAGACCA | GTTGCCGGCACCTCCCCA |
| REPS1 | TCATCCCAGCGGTGGGAA | CTGACCACACTGCATCACCA |
| RET | CTGCTTCCCTGAGGAGGAGA | AGAGGAGTAGCTGACCGGGA |
| RETN | GTGCCAGAGCGTCACCTCCA | GTGGTCTCGGCGCGCACA |
| RHBDF2 | TCACAGGCAACCTCGCCA | AGCCGAAGATGTGGGCGA |
| RIN2 | CTGACAGCAAACCCCCGA | TGACGCAGGGAGGCAGGA |
| RLBP1 | CTTCATCCGCGCACGGAA | AGCATGACCACTCGGCCA |
| RNF13 | TATCGGAATCCCGCTCACA | CCATTAGGCTGCAACTGGACCA |
| RNF130 | AAGATCAGCCCTCGGCGA | AGGGCACTGAGGAGGCCA |
| RNF149 | TACGGGAACATCACCTTGCCCA | ACACCACAGACTGACCGCTGA |
| ROBO1 | GGATACGGATGCGCCAGA | CATGGACCCCGTGACAGA |
| ROR1 | CTGAAGACTGCCCACCCAGA | TGGGCTGGCACTGAGGGA |
| ROR2 | TGACACACAGAACGCCCCAGA | GGCCTCGTCCACCTGCAGA |
| RORC | GGAGCCTGTGTAGCCAGCA | AAGCGGCTTGGACCACGA |
| RPN1 | CAGCCGCAGAAGCCAGGA | GGTGGAGATGTCCCGGGA |
| RPN2 | GAGGAGACTGTGCTGGCAACA | CGAGTTCATCCAGGCGAGCA |
| RRAD | CACGACGGCAAGCAGGCA | AACCGAGAGGTCGTGGCA |
| RTN4R | AGGCCAGGCTGTTCACGCAA | GCTGCAGGTGAGGCTGGGTA |
| RUNX1 | GTCCACAGTCCACGGTACACA | CTCAGGCTGGGCACGACGAA |
| RYK | GCCAGACTCCCTACGTGGACA | CTCTGGATCTAAGGCCCAGCA |
| RYR2 | CTACACGCAGTCAGAAACGGAA | GACGGCGACGTTGAAGCCGA |
| S100A8 | CCGTCTACAGGGATGACCTGA | ACCAGAATGAGGAACTCCTGGA |
| S1PR1 | ACTCCGGCACCAACCCCA | AGAGTCTCCGCTCGGGCA |
| S1PR2 | CTGCCTCTCTACGCCAAGCA | CGTGGCTTGAGCGGACCA |
| S1PR3 | GTCCATGGCACTGCTGCGGA | ATGACCGGGTTCATGGCGGA |
| S1PR4 | CGTCGAGGCTCACTCCGGA | TGGACAGGGGCTCCCGCA |
| S1PR5 | CTGCGGGGACCACCTCGA | GCCAGTCCCAGGAAGGGA |
| SCARA5 | AATGGCTCAGGTCCGCACGA | CCTCCTCCACACCGCGGA |
| SCARB1 | CGGTCACGGGAATCCCCA | TGGCAGATGACAGGGACCA |
| SCARF2 | CGGGACCTCCAGGGGCGA | GCCAAGCCCCCGCCGGGA |
| SCN2B | TGCCACCCTCAACGTCCTCA | TCTCAGCATCACCGACACA |
| SCN4B | CGGCGAGATGGCTGGGCA | CCGGAAGTGGAGGTCCTCGA |
| SCNN1D | GGAACCGCCTCAAGACGA | CCGTCACACAGGGTGACCA |
| SDC1 | TGCTGAGGATGGAGCCTCCA | CAGGCTCCACGGCCACTACA |
| SDC2 | ATGTACCTTGACAACAGCTCCA | TCATCAGCTCCCGAGCCA |
| SDK1 | TCAGCTCAAGTGGAAGCCCCA | ATTCTGCCCCGTGCAGGACGA |

FIG. 8 (Cont.)

| Gene Name | Forward GSP | Reverse GSP |
| --- | --- | --- |
| SDK2 | GGTACAGCTCTGCCATCGCCA | CTCACGCCCGGCTTCAGGA |
| SECISBP2L | TCCATTTGACACACCCCCA | TGTGAGGCCCATTCCAGGTCA |
| SEL1L | AGCTGAAGCCAGCCCAGA | GTTCCCAACAGCAGCGCA |
| SELE | GGGACAACGAGAAGCCCA | TCCTCACAGCTGAAGGCACA |
| SELL | CAAGGAGGACTGCGTGGAGA | CATGACCAGGGCTGGCAAGA |
| SELP | CTGCACAAACAGCATGCCA | CGTAGAAGCCACCGCTCCA |
| SELPLG | TCCCATGGCAGCCAGCAA | CCTCACCCCCATCAGGCA |
| SEMA3A | GGCAATTCCAGAGGCGAA | AACCCATGTTCCACCGCA |
| SEMA3C | ACGGACAAATGGTCCCCA | AGTGGCTGAATGCCCCCA |
| SEMA4A | TGGACAGCCAGGACCAGA | CTCTCAATGGGGAGGCCA |
| SEMA4B | GTAGCCAGCTACTGCCCAGA | AGCAGCACGGCCAGCACA |
| SEMA4C | GGCCCTGTCCTGAACCAGA | GCCGAGTTGGAGAAGGCA |
| SEMA4D | GCGTGTTGAAGGCCGAGA | CAGGCACTGGTACACCCCA |
| SEMA4F | GGACACCTCCACCGAGCA | GCTCTGGAGACGGCCACA |
| SEMA4G | GCCTGAGCACAGTGGCAA | AGGATGAGGCAGAGGCCA |
| SEMA5A | GCAACAACCCCGAACCCA | GGGGACCAGCAAGACCACA |
| SEMA6B | GGCTTAGGGGACTGCACAGGA | CACGGAGGCCCACGAACCA |
| SEMA7A | ACAAGGAGAACGTGGAGCAGA | CAGTGCTGAGCCTCGCGGA |
| SERPINA1 | GAGGACTTCCACGTGGACCA | GCAGCACCCAGCTGGACA |
| SERPINA3 | GAGGAAGCCTTCACCAGCAA | CAAGCACAGCCTTATGGACCA |
| SERPINB2 | TCAGCGCACACCTGTACAGA | TCCAGCAGCTCCAAGCCA |
| SERPINE2 | GTCGACAAGTGCCCCCAA | TCGGCAGTGCAATCAGCA |
| SERPINF1 | AAGCTCGCCAGGTCCACA | AACAGCCTTAGGGTCCGACA |
| SERPING1 | CAGCACCAGACAGTGCTGGAA | CGAAGAGGAAGGGCTGCTGCA |
| SERPINI1 | CAAAATGTAGCCGTGGCCAA | GAGGGCCAGATAAGTGGCA |
| SEZ6L2 | AGGTCCCGAGGAACGACA | AGCCTAGCAGCTCGTAGCCA |
| SFTPB | AGAATGGCTGCCGCGAGA | CAACACAGGCCTGGAGCA |
| SFTPC | TTCCAGGCCAAGCCCGCA | TAGAGCGGCACCTCGCCA |
| SFTPD | GCACACAGGCTGGTGGACA | CAGTCCTCTGACCCGCCA |
| SGCB | AGAAGGCTGTTGAGAGAAGGA | AATGCGAATCACGGCCCA |
| SGCD | GAAGCCACCTGCAGGACAGA | CCCATTGGCGCAGACGCA |
| SGCE | ATGTGCTGCCGACGGGAA | AAGCGTTGACAGGGGCCA |
| SGCZ | TGAGAGCCAGTGAAGATGGCA | GCGTCTCCACAGAGTGCCCA |
| SIDT2 | GCAGAGTCGAGGGAGCACA | ACACCAGGAAGGACCCGA |
| SIGLEC1 | CTGGCGTCTACACCTGCCAA | GGCATCCTCCAGCAGGACA |
| SIGLEC10 | CATCCTGCAGCTGCCAGA | GATGATCAGGGCCAGGCA |
| SIGLEC12 | GGAAGGGGGATTCAGGGA | CCCCTGTTCACAGGCCCA |
| SIGLEC5 | CTGGAGGGGAACAGCAGCCA | GACAGATACAGAGCAGGGCCA |
| SIGLEC6 | CCAGGACCACAGCACCAA | GGGGAAGCCCTGGAACCA |
| SIGLEC7 | AGCCAGACTGACTCTGACCCA | TTCCTCCTGCACTGCCCAA |
| SIGLEC8 | GGGGAGGGACCTGGTGGGA | GGCGGGGGAGGCCTCAGGA |

FIG. 8 (Cont.)

| Gene Name | Forward GSP | Reverse GSP |
|---|---|---|
| SIGLEC9 | GGCCCAACATCCTCATCCCA | GACACGGAGGTCCCTATCCA |
| SIRPA | AGCCCACCCGAAGGAGCA | CCGCCATCAGTAGGGCCA |
| SIRPB1 | GGAGACTCACAGGAGTGGCA | GGGATCAGGGACGTCATAGCA |
| SIRPG | GCATCCGCAGCACAGCCA | CAAGTTGGCAGTCCCACGA |
| SLAMF1 | AGGAGAACGGGACCTGCA | GTGAGGGACAGGAGGTGGGA |
| SLAMF6 | ATGGGAGGCCTTGGGAAACACA | ATCTTCGCAAAGCTTCTGGGCA |
| SLAMF7 | AAGCAGCCAATGAGTCCCA | CAGAGCTTCCTGGCAAGGA |
| SLAMF8 | GGCGACGGGAGACAACCA | CAGCATCAGGAGCAGCGA |
| SLC12A6 | AGAGCGAGACAGAGAGGCACA | GTCCGGACGCATGTTAAGCA |
| SLC12A7 | GACACCGTCCGCGACACCA | GTTGTCGTCCACCTGGGCCA |
| SLC12A9 | GGACCCTGTACAGCCGCA | CCGGAGATTCGCAGCAGA |
| SLC14A1 | GATAATCCATGGACAGGGGGCA | CGACTCCAAGATAGGCCGTGA |
| SLC17A6 | CAAATTCAACTGGGACCCGGAA | CTGTTGGCTGCCAGCCGAGA |
| SLC17A7 | AAGCACAAGACTCGGGAGGA | TGTCGTCACTGCCAGCCA |
| SLC1A3 | GACAAGCGCGTCACCAGA | CCGCGATGATGAGCGTGA |
| SLC22A16 | ATGGACAAGGTCGGGAGGAGA | GTCCACAGAGAACGGCGCCA |
| SLC23A2 | GCCAGCTCATTGGGACCA | CGGATCCGGGGATACCAGA |
| SLC26A5 | GGAACCGGTGGGAAGACACA | CAATCACAATGGCCGACAGCA |
| SLC29A1 | CAGAGACCGCAGGAGCCA | TGCCCGGAACAGGAAGGA |
| SLC29A2 | GCTCCACCAGTCCTGGGAA | TCTGGGGCACGTGGCACA |
| SLC29A4 | GGGTGATCTGGGCCGACA | GAAGACCACACGCAGGCA |
| SLC2A1 | CTCCACGAGCATCTTCGAGA | CAGGGTAGCTGCTCCAGCA |
| SLC2A2 | AAATTGGGCCAGGCCCGA | AAGGCCAGGAGCACTCCA |
| SLC2A4 | CCTGGGGACGCTCAACCA | AGAAGGGCAGCAGGACCA |
| SLC32A1 | CGTGGTGGTGAGTGGCAA | AGTGGGCCAGAGTGCACA |
| SLC38A1 | TGACAACGTGCAGTCCGA | AGGTAACCACGGTATGACGACA |
| SLC39A10 | CCAGTGGCACCACAAGCA | GCACCAATTGCGAGCCCA |
| SLC39A14 | GAAGCTGCAGAACGGGGA | GCGGACACCTTTCAGCCA |
| SLC39A6 | CAGCGCTACTCTCGGGAGGA | AGCAGCACCAATTGCTAGGCCA |
| SLC3A2 | CTGCTCAGCACCCAGCCA | CGTAGGGGAAGCGGAGCA |
| SLC44A1 | TAGGTACGGTGGCAAAAGGA | TCAGCACACATCGTGCACA |
| SLC46A1 | CGGGCCCAGGGTTATGCCAA | TAAGATGTCCTGGGCCCCA |
| SLC4A1 | TCACGTCGCTCAGCGGCA | CGTGGACTTCACCACCCA |
| SLC4A7 | TGAACCTCCAAACCCCAGCAA | GATGACCACAAGCTGACCCCA |
| SLC6A6 | CCTGGAATCGACCACCCA | AGGCGGGTGATGTCAGGA |
| SLC7A5 | CCCTGGCCATCATCGGCA | TCCAGAAGGAGACGGCGA |
| SLC8A1 | CCATCTACCACGCAGCCA | CGATACAGCAGCACCCCCA |
| SLC8B1 | GATCTCCCGAAGCCACACAGA | CAGGTAGAAGAGGAGCAGGCA |
| SLC9A1 | GATGCTGCTCCGGAGGCAGA | GGTCGATGGTGATGACAGGCA |
| SLCO2A1 | CCCCGCATAGCTACCACCA | GGGGTAGACTTCGGCCACA |
| SLCO3A1 | CCCGAAGGTCACCAAGCA | CCAGACAAGCACACGGGA |

FIG. 8 (Cont.)

| Gene Name | Forward GSP | Reverse GSP |
|---|---|---|
| SLCO4A1 | TCGGCTGGGTGATCGACA | CACCTTGTACAGGAGCCCCA |
| SLCO4C1 | TCCGAAGAGAAGCTCCGGTCA | CAATACCTTGCGTGACGGCCA |
| SLIT2 | TGGACCGCTGAGGAGCAA | ACACCTCGTACAGCCGCA |
| SLIT3 | CAGGTGGCCACTGACAAGGA | AGCGTCACCAGCTCCACA |
| SLITRK2 | GCTAGAAAAGCAGGCCACACCA | GACTAGGCCTGCGCTGGGAA |
| SLITRK3 | GGCATCCAAATGCAATGCCACA | CTCATACACATGACCCACGGGA |
| SLITRK4 | TCCGGAGCACCCTTAGCTA | TCACAACAATCCCGTCGCTCA |
| SLITRK6 | CCCCCGGGCATCTCGACA | TTGTTGCAGGAGTGGTGACCA |
| SMAD2 | GAGCAGAATACCGAAGGCAGA | GCAACGCACTGAAGGGGA |
| SMO | GGCCTTCTCTAAGCGGCA | TGCCACAGGGGTGACAGA |
| SMPD3 | GGGTACATCGCCTGCACA | GTTGGCTGCGCTGGACGA |
| SMPDL3B | CTCGAGTACCAGCTGACCGA | CAATGTCCACCTGGCGCA |
| SMTN | CCTCAGAACCGACGCCAGA | ACCTCCACCAGGGGCACA |
| SORCS1 | ACCCTGAACCACCCAAGCAACA | CAAGCACCCCACTGCTCTCAA |
| SORCS2 | GAACCTTACACTGACCGGGGA | TTGAGGCCAATGACAGGAACCA |
| SORL1 | CAGTGGGTCCCAGATGGAGA | CCCTGAGGGCAGTCACACA |
| SORT1 | AGCCGAATGCCGTAGGCA | GATGCCTCCAGAATCCAGGA |
| SOX17 | GAGGTGGACCGCACGGAA | AGCTGGCGTCGGACACCA |
| SOX2 | ACATGAACGGCTCGCCCA | CCTCGGACTTGACCACCGA |
| SOX7 | AACACTCCTGGCCACCCA | TGGCCGTGGCATCAGCCA |
| SPANXC | GGCCAACGAGATGATGCCGGA | ACGTTCCTCCTGTAGCGAACCA |
| SPN | GTCTCCAACGACCTCCACCA | CGCCACAGCAGGAGCAGA |
| SPPL2A | GCACAACCAAGGACTACTGCA | GGCAGCTTCCCCATGGAA |
| SPPL2B | CATCACGCCCTTCCTGACCAA | CAAAATGTCTCCGAAACCCAGGA |
| SRPRA | AGCATGGTGGCCGCACCA | CTGCCGTGTCCACCAGCA |
| SSR1 | CCCATGGGCGGACGACCA | CTAGGAGTTGATGAAGGCCA |
| SSR2 | GCACCTGGACAGGGAGGAA | CGATGGAGGGAAGGGTCA |
| SST | GGACCCCAGACTCCGTCA | GATCTTCAGGTTCCAGGGCA |
| ST3GAL1 | CAACTGGCTGCAAGGGCA | CAAGTCCACCTCATCGCAGA |
| ST3GAL4 | CAAACTGCTGAGCCTGCCAA | CACAGAGGTGGAGGGCCA |
| ST6GAL1 | CCTCCCATCCAAGCGCAA | TCATAGAGCAGCGGGTGGTA |
| STAB1 | GGCCTATGGCATCGACCA | CCTGTGACCCCTCAGGACA |
| STAT4 | GGTACAACGTGTCAACCAACGA | TAAGACCACGACCAACGTACGA |
| STAT6 | GACCGTGGAAAGGGACCA | TGGAGGAATCAGGGGCCA |
| STEAP4 | GAGGCACAAAATACCGTCGA | GAATCACTGAGCCAGGCTGA |
| STIM1 | CTGCCCTCAACATAGACCCCA | GCTGCCGAACACTGCTCTGCA |
| STS | CCCTTGCCTGAGGACAGGA | TCTGAGGGTGCCAGCGCA |
| SUCNR1 | GTGCACCCTCCCCATGCTGA | TAAAACCCAAATGGCCAAGGAGA |
| SUCO | TGGGCAGCGGTGAACAGGAA | CTGCGCTGCCGATAAAGAGCA |
| SUSD1 | CCACGCCTCAGACTGAGGA | CTTTGGAGGGCCAGGGGA |
| SUSD2 | GCTGAGCTTCACCGAGCA | CAGGCAGCAGGACGGACA |

FIG. 8 (Cont.)

| Gene Name | Forward GSP | Reverse GSP |
|---|---|---|
| SUSD5 | AAGCGAGGGCATGACCCA | GCCCTCAGTCTCGGAAGCA |
| SV2A | CGTGACAGGGACGGGCGAA | ACAGTCAACACGTCCAGCGCA |
| SYT17 | GACCGGGGTCAAACGCAA | AATCAGCGCCTTCCACCA |
| TACSTD2 | CGGTATCGTCCCAGACCCAA | AGGAGACCCTGAGGCCAGGA |
| TAGLN | GCAGCTTGGCAGTGACCAA | CTGCCCATCTGAAGGCCA |
| TAT | CCATCCCTGGACTCCGGCCA | CTAACCGCTCCGTGAACTCCA |
| TBX21 | GGACTGAGATTGCCCCCA | GAGGAGCTGTCACCACTGGA |
| TBXA2R | GATGGCTCAGCTCCTGGGGA | TCCAGGTGGCCACGCGCA |
| TBXT | CATGTGAAGCAGCAAGGCCCA | CCAGTCACCACTGGCTGCCA |
| TCTN2 | CACGTTGCAATGAGAGGCAA | CGGATGCTCAGGTGAGCA |
| TEK | AGAAGCGGCCTAGGACAGAACA | GGTCCCAGGTGTACAGCACA |
| TENM1 | AAGTCCAGCCTAGGGCAGCA | TGACCTCGGCTGCTGAACACA |
| TENM2 | GCGACCTGGTCACACTAGGCA | AGTCCTGCCGTTGACCAGCA |
| TF | CCGAAGACTGCATCGCCA | CTGCCAAGACAGGCACCA |
| TFPI | GTATGGTGGATGCCTGGGCAA | GTTGATTGCGGAGTCAGGGA |
| TFPI2 | CGGTGGGTGTCACCGGAA | TTGGTGCGCAGAAGCCCA |
| TGFB1 | TGCTTCAGCTCCACGGAGA | CCGAGGCAGAAGTTGGCA |
| TGFBR2 | AGCCCAGTGTGTGGCAGA | TAGGGAGCCGTCTTCAGGA |
| TGFBR3 | TCCTGCTCAACTCCCCACA | TGGACCACAGAACCCTCAGACA |
| TH | GTGCAGCCCTACCAAGACCA | CGCTGGATGCGTGAGGCA |
| THBD | GCAGCGCTGTGTCAACACA | GCTGGCACTGGTACTCGCA |
| THBS1 | ACTCGTGCCCAATCCCGA | TAACCTACAGCGAGTCCAGGA |
| THSD1 | CCTCAGAGTCGAGGTGCCCA | TTCCTCAAGGGCTGCCCCA |
| THSD4 | GGAACAACCGGCCGGCAGA | CCGCTCCCACACTCGATGGA |
| THSD7A | CAGCATCTGTGCCCAGAGCA | GACACCACACTGTTCGGGAAGA |
| THY1 | GACCCGTGAGACAAAGAAGCA | TGAAGGCGGATAAGTAGAGGA |
| TIE1 | GGCCCTCTCAGACTCCGAGA | GCCACCTGCACCTCCACA |
| TIGIT | AGGAGGAATGGAGCCCCA | GTCATGCAGCTCGGCACA |
| TIMP1 | CCGGGGCTTCACCAAGACCTA | TGGCTCCCGAGGCAGGCA |
| TLL1 | CCATGAGGCACTGGGAAAAGCA | CCTCGCCGACCTACATAGGA |
| TLL2 | TCGGATGCCTCAGTGCAGA | TCCCCAAACTGGGCGTGGGAA |
| TLR1 | GCTGGAACCCATTCCGCA | GCTGCCCTTAAGTTAGCCCA |
| TLR2 | GCAGCAAGCACTGGCCAA | CCGTGAGCAGGATCAGCA |
| TLR3 | CACAGGCCAGGAATGGAGA | AGGCTTGGGACCAAGGCA |
| TLR4 | TGGATCAAGGACCAGAGGCA | TGCAGCCAGCAAGAAGCA |
| TLR6 | CGTCACCATCGGTGCCACCA | TTCCTGGCCCTGCGCCGA |
| TLR9 | TGGCAGACTGGGTGTACAACGA | GCGGCTGCCATAGACCGA |
| TM2D1 | CGAGGACCTCAAAGTGGGACA | AAAAAGAGACAATGCGACTGCCA |
| TM2D3 | CTGCACGGTGCGGGACCA | CCAGGCCACCGAAGCTGA |
| TM9SF1 | CCGGCAGATTGGAGGCGA | CCGTCAGAAGCAGCAGGA |
| TM9SF3 | GAAATCTGTCAGGTCAGCCCAA | ACAGGATAACCAGCACCAGCA |

FIG. 8 (Cont.)

| Gene Name | Forward GSP | Reverse GSP |
|---|---|---|
| TMCO3 | TCCATCGAACCCATCCGCGA | GAAAACTCGCTGACCTGGGCA |
| TMED4 | GAAGGACCCCGACGGCAA | CATGCTCCCCAACCTGGA |
| TMED7 | GGGTGCAGGCTGCTCGCA | GTCAGGAAGCTCGAAGGTGA |
| TMED9 | AAGCAGCGGGAGGAGTACCA | TGAACCTGCCCTCGGAGCCA |
| TMEFF1 | CGGCGGCAAAGGCAAGAGCA | TACAAGCAGCCCTTCTGAGA |
| TMEM131L | CCGCCCTACCTCACAAGCA | GGGGTTGATGGGGCAGCA |
| TMEM132A | CCTGTGAGAGTGGGGGAGGA | GTCCTCACACACCCAGCGGA |
| TMEM132E | CCTACCCCATCCCACAGCCA | AGCTGCTGCCCCCACCTCCA |
| TMEM231 | CCTGAGGCTGCAGCAGAAGCA | CCTCTCCTGGTAGGCAGCAA |
| TMEM25 | ATCGACCAGGATGGGCCA | CTTCCACCCGGGTAGCCA |
| TMEM87A | AAACTTGGCAAGATGCACCA | ATCTCTCCAGTAGCAGGCAGA |
| TMEM87B | GCAACACTGGACTGTCAACCCA | ATCACGCCTTCAACAGCTGCA |
| TMEM8A | CCTCCGTCTACGCCTACACCA | AGGGCCCCAGCATGTTCCACA |
| TMEM9 | GCGAGTGCAGGTACGAGGA | CGGATCAGAGGGTCCACCA |
| TMIGD2 | CAGGGACGGCTCTCCTGGCA | CAGCCTCCTCCAACTCAGGAA |
| TMPRSS5 | GGGAGTCAGGACCCTCTCCA | TCCAGTGTACCCACCCCACA |
| TMX3 | CTGCGGCTCTGCGCCACA | TGGCCACACCATGGCGCA |
| TMX4 | TTGCAGGATGCGGAGGAGGAA | CTCTCCTCATCCACACCAGCA |
| TNC | AGGGGTACAGTGGGACAGCA | GCCCTTCCAGTGGAACCA |
| TNFRSF10B | AATAGCATGTGACACAGGACAGCCA | AGGGCAGAAGCATGAAAGGACACCA |
| TNFRSF10C | CACAGCTTCAAGGGGGAGGA | TGCACGGGTTACAGGCTCCA |
| TNFRSF11A | CTGCACAGGCTGCCGGAA | AGCCTCCCATCAGCCCCA |
| TNFRSF11B | AGAAAGTGGGAGCAGAAGACA | ACAAACTGAGCAGCTTCAGGA |
| TNFRSF12A | ACGATGCCGCAGGAGAGAGA | ATCAGCGCCACAGCTGGGCA |
| TNFRSF13C | AGCCCCTGGACAAGGTCA | CCAGGAGGAGGCCAGGCA |
| TNFRSF14 | TGCAAGGAGGACGAGTACCCA | AGGCCATTGAGGTGGGCA |
| TNFRSF17 | CTGCATCAAGAGCAAACCGA | GCACTCAAAGCAGCTGGCA |
| TNFRSF18 | CAGGAGGGAGAGAGAGACACA | GCACTGCACACCCACGGACA |
| TNFRSF1A | AAGAGGGGGAGCTTGAAGGA | TGAAGGTGGAACTGGGCA |
| TNFRSF21 | AGAAGTCCAGCACGCCCA | TCCGGATACTGCACACCACA |
| TNFRSF25 | CCTTGGACAGCGCCCACA | ATGTCACCTGCGGGCAGA |
| TNFRSF4 | GCCCAGAACCTCACAGGGA | GGAGCAGGTACAGGGCCA |
| TNFRSF8 | CTGCATCACCCACAGCCGCA | CTCCCATCATGGGCGCCAGA |
| TNFRSF9 | TGGGACGAAGGAGAGGGA | GCAGTCGACGTCAGCGCA |
| TNFSF10 | GACCCAGCCTGGGACAGA | CGTAAGTTACAGCCACACAGAGA |
| TNFSF13 | CAGAGGTGATGTGGCAACCA | CTTCTCGAGACACCACCTGA |
| TNFSF14 | ACCCCGCTACCCCGAGGA | ACCGGGTACCATCACGCA |
| TNFSF18 | GGCCAAGTGGCTCCCAATGCA | TCTATGGTGTCCCCAACATGCA |
| TNFSF9 | GCAGCCCACCTGGACAGA | GGAGGTCAGCAGCAGGGA |
| TNXB | GCAATGAGGCCCTGCACA | GTCCCGATCACGGGCAGA |
| TPBG | ACAGAGGTAGTGCAGGGCAA | GGTCACAGTCCAGGTCAGCA |

FIG. 8 (Cont.)

| Gene Name | Forward GSP | Reverse GSP |
|---|---|---|
| TPSAB1 | TGGCGCCTACACGGGAGA | GTGCCATTCACCTTGCACA |
| TREM1 | CCAAGCTCCACCCAAGTCAA | GACCTCAGCGTGACAGCAA |
| TREML2 | GCCAGGGACCCAGGAGGA | CTGGTGCTGAGGTCCCCAGA |
| TRHR | CAGGTCACCAAGATGCTGGCA | AGCTTTCTGAAGGCTGCACGGA |
| TRIL | TGCCCCCAACATGGCCAGAA | GCAGAGATCACCAAACCAGTGGA |
| TRPV2 | ACTGGGCTTCATGGGAGCAGA | GAGGAGCTGGACGGGCACA |
| TSHR | GCCCAGTACGCAGACTCTGAA | CCAGCTGCTGCAGAGTCACA |
| TSPAN7 | TGAGGACTTACACGGACGCTA | CTGCACACCACAGCAGCTCA |
| TSPAN8 | GTGGCGACAGGTATCCTAGGA | ATCAGCAGCTCCATTGACCA |
| TTYH2 | CGGCTCACAGTCCCCCGA | CGGAGACAGGGGCGTTGGA |
| TTYH3 | CCCGCACACCTGGCAGCAA | ACAGCTGTACAGGCTGGGCA |
| TUBB3 | TGAGGAGTATCCCGACCGCA | CACCAGCTGGTGGATGGACA |
| TXNDC15 | GGCAGCAGAAGAGGCCAA | GTCCTCAGCTTCCCCAGGAA |
| TYR | AATGGAACGCCCGAGGGA | CTACATCAGCTGAAGAGGGGA |
| TYRO3 | GCATGCTGGCAGAGGACA | CCAGCCACTTGACAGGCA |
| TYRP1 | GCACCGAGGATGGGCCAA | AACTTCCAAGCACTGAGCGA |
| UGT8 | ACCAGAGTACAGGCAAAAGGCA | TCGATTGACAGGGTGACCA |
| ULBP2 | CAGCTGGAGAATTACACACCCA | AAAGAGGAGGAAGATCTGCCCA |
| ULBP3 | CTGAGAGAGGTGGGGCAGA | CGAAGCTGAACTGCCAAGA |
| UMOD | CCAGGACAGATGCCCACA | CCGGAACATCTGGACGGA |
| UNC5A | CCACAACCTGCGCCTATCCA | GCAAGTACCGCTGCGTGCCA |
| UNC5B | TCCCACTGTCCATCCGCCAGA | AGCTTCCCAGAGGTCCAGGA |
| UNC5C | CAGCCTGTGAACATCAAGGCA | CTGAGACGTCATGCAGGGCA |
| USP9Y | CTCCAGAGGAACAAGGGCAA | GCAAAACAGGAACCACCCA |
| VAMP5 | GCAGCAGCGTTCAGACCAA | CAATCAGGATGATGAGCAGGA |
| VASN | CAGTGAAGGAAGCTCCCGGA | GGGGCCAAGACTAGAGTCACACA |
| VCAM1 | CCAGTTGAAGGATGCGGGA | AGAGCACGAGAAGCTCAGGA |
| VCAN | GGGCACAGACCACTGAGCA | CGGCAGCAGCTTCTCCAGA |
| VDAC1 | GGGTACAAGCGGGAGCACA | GGCCAGCCAGCCCTCGTA |
| VEGFC | ACAAGACCTGCCCCACCA | CCACAGCTGGCAGGCCGA |
| VIPR1 | GAACCCCAAATACCGGCA | GGCTTGGAAGCTGGAGGA |
| VNN1 | AATGTACCCAAGGAGCCTGAGA | CCTCATGCCCATAGCCCA |
| VNN2 | CCGTGTCAAGACCCCCACAGA | GGACATGTGGAGTCACGGGA |
| VSIG10 | CCAGCTGTCGGATGGCAA | AGCGTCACATTGCCCCCA |
| VSIR | CGAGGCCAAAGTCAGGCA | AGGGACAGGGTCCAGGGA |
| VSTM1 | CAGAGCTCGGCAGAAAACGA | TGCAGCTGAAGATGGCGA |
| VSTM4 | CTCCCAGAAAAGGCGGAAGGA | CATAGTACTGCACCACCCGGA |
| VTN | CTGCCACCTGTGAACCCA | CCCAGCCAGTACTGAGCGA |
| VWF | ACTGCAGCTCAGCCCCAA | CAAGACACTGCTCCTCCAGGA |
| WNT11 | CGGGACACAAGACAGGCA | GGCAGGTGACGTAGCAGCA |
| WNT5A | ACAAGACGTCGGAGGGCA | TGCACTTGACGTAGCAGCA |

FIG. 8 (Cont.)

| Gene Name | Forward GSP | Reverse GSP |
|---|---|---|
| WNT5B | ACAAGACCTCGGAGGGCA | CGAAGCAGCACCAGTGGA |
| YBX1 | AGGGGCCCTCCTCGCCAA | TTGAAGTTGCGGCGGTACCGA |
| ZDHHC5 | GCAACGGGAAGCTGAGAGGCA | TCGTTCCTGGAGAGAGGCCA |
| ZFP42 | AGACCACGTCTGTGCGGA | TGGATGCGCACGTGCGTA |
| ZIC1 | CGCCAGCTCTGGCTACGAA | GTGGACTGCGGAGGAGGA |
| ZNF205 | CGGAAGAGCTTCAGCCACCA | AAGTCCGAGCGGCGGGTGAA |
| ZP4 | CTGGTCCAACAACCAACAACATGGA | GAGTGGCAGGGAACGTGACA |

MULTIPLEX PREPARATION OF BARCODED GENE SPECIFIC DNA FRAGMENTS

CROSS-REFERENCE TO RELATED APPLICATIONS

This application is a continuation of U.S. application Ser. No. 17/587,500 filed on Jan. 28, 2022, which application is a continuation of U.S. application Ser. No. 16/543,211 filed on Aug. 16, 2019, which application, pursuant to 35 U.S.C. § 119(e), claims priority to U.S. Provisional Application Ser. No. 62/765,124 filed on Aug. 17, 2018, and U.S. Provisional Application Ser. No. 62/799,448 filed Jan. 31, 2019, the disclosures of which applications are herein incorporated by reference.

INCORPORATION-BY-REFERENCE OF MATERIAL ELECTRONICALLY SUBMITTED

A Sequence Listing is provided herewith as a Sequence Listing XML, "CLCT-005DIVCON_SEQ_LIST" created on Apr. 5, 2023, and having a size of 9,362,580 bytes. The contents of the Sequence Listing XML are incorporated by reference herein in their entirety.

INTRODUCTION

Multiplex polymerase chains reactions (multiplex PCR) include the simultaneous amplification of many DNA sequences in one reaction. Applications of multiplex PCR include, but are not limited to, the identification of mutations, gene deletions, and polymorphisms and the production or quantitation of amplicons for high throughput sequencing and genotyping. Multiplex reactions may include two or more target sequences with primer pairs or one template selectively amplified with primers designed to target specific regions. Additionally, such reactions may include multiple templates with regions multiplied by multiple primer pairs.

During multiplex PCR, proper amplification requires optimal conditions. It is important to maintain controlled cycling and annealing temperatures and fine-tuned relative concentrations of primers, buffers, dNTP's, Taq DNA polymerase, template and other PCR reagents. Common problems associated with multiplex PCR include: i) mis-priming due to nonspecific primer binding to non-target templates; and ii) the formation of unwanted side products due to the presence of multiple primer pairs. In conjunction with several other sensitive procedural variables, these issues may lead to cross hybridization, and uneven or no amplification of some target sequences. Unwanted multiplex PCR side products form in the presence of multiple primer pairs. These side products may include homodimers, formed by inter-molecular base pairing between two similar primers, and heterodimers, formed from inter-molecular interactions between sense and antisense primers. Another undesirable occurrence is the formation of hairpins and fold-back structures from intra-molecular interactions.

Furthermore, the technological problems with design of PCR primers and assay optimization are compounded in the analysis of small nucleic acid samples from large numbers of biological samples, like small amounts of clinical samples and in single cells. One of the best strategies of processing large numbers of biological samples is labeling of target nucleic acids (e.g. mRNAs) present in every sample with unique sample-specific barcodes, where the barcodes are employed to denote the source of each particular sample. These sample-specific barcodes can be used for deconvolution of the final multiplex profiling data and assigning these data to specific originating samples. Current RNA barcode labelling technologies are based on the mixing together of biological samples, e.g., from single cells, with universal (not gene-specific) sample-specific barcoded primers (e.g. oligo dT), e.g., present in a micro well or in a single droplet. The plurality (i.e., more than one) of barcoded oligo dT primers are commonly synthesized on the surface of beads using combinatorial phosphoramidite chemistry with one specific barcode labeled oligo dT primer per bead. In another strategy, the barcoded primers with unique barcodes are synthesized separately, optionally immobilized on the beads or encapsulated in a matrix (e.g. acrylamide) and deposited in a separate compartment (e.g., microwell). Each oligo dT primer with a sample-specific barcode (e.g., attached to the single bead) is annealed to the conservative polyA+ mRNA portion and extended by reverse transcriptase. As a result, the oligo dT-extended first strand cDNA molecules derived from one sample are labeled with a sample-specific barcode, and these cDNA molecules may then be mixed together with other barcode labeled cDNAs derived from other samples (e.g., cDNAs derived from 10,000 cells in the current 10×Genomics platform), where the resultant pooled mixture may then be amplified as a pool and analyzed for sequence and composition using next generation sequencing (NGS) protocols.

To date, known barcode labelling strategies can only be used in multiplex targeted PCR assays with a combination of forward gene-specific primers, which allow one to amplify and analyze only the 3-end of RNA molecules. Unfortunately, non-coding 3-end portions of mRNAs are highly promiscuous in different cell types and disease states. As a result, the design of gene-specific primers for the amplification of 3-ends of mRNA molecules is highly problematic and there are significant obstacles to using this strategy for expression profiling in different disease states, e.g., for profiling different cancer cell types. Furthermore, the barcoded oligo dT primers cannot be directly applied for conventional multiplex PCR assay, employing two gene-specific primers (forward and reverse), as the barcoded domain of the oligo dT primers are not physically connected with any gene-specific primer or amplified products. Importantly, multiplex targeted PCR assay commonly employs set of hundreds-thousands of gene-specific primers. Therefore, it is technologically challenging to label such a plurality of primers with, e.g., 10,000 different sample-specific barcodes, and deliver each barcoded primer pool to different samples or cells.

In some instances, the multiplex PCR primers may also incorporate unique molecular identifiers (UMI), the highly complex (usually random) sequences which allow one to label each nucleic acid molecule used in the assay with molecule-specific identifiers. The UMIs are useful in identification and elimination of PCR duplicate biases introduced during multiplex amplification steps.

Although genome-wide analysis of nucleic acid compositions can be achieved by many known technologies, multiplex PCR is a unique technology which can be designed for analysis of hundreds or thousands of distinct nucleic acid molecules or their fragments. The complexity and composition of a nucleic acid pool which needs to be amplified and analyzed in such multiplex targeted PCR assays is dependent on specific application. As a result, reduction in complexity of analyzed nucleic acids provides dramatic improvement in the sensitivity and specificity of the assay for many critical applications, including single-cell analyses and clinical diagnostics. Combination of multiplex PCR assays with sample-specific barcodes is the next frontier in reducing cost and quality of the analysis of multiple biological samples for clinical and experimental research applications.

SUMMARY

Methods of preparing a plurality of sample-barcoded anchor-domain-flanked gene specific deoxyribonucleic acid (DNA) fragments from a template nucleic acid, e.g., ribonucleic acid (RNA), sample are provided. Aspects of the methods include employing a set of gene specific primer pairs, wherein each pair of gene specific primers is made up of a forward primer and a reverse primer, at least one of which includes a sample barcode domain. The methods find use in a variety of different applications, including high-throughput sequencing, e.g., expression profiling, applications, including of small biological samples, e.g., single-cells.

BRIEF DESCRIPTION OF THE FIGURES

FIG. 7 shows Table 1 which provides examples of suitable sequences for 18 nt long barcode domains. The sequences in each vertical column from left to right are set forth in the following SEQ ID NO's: (i) 85-2104 (ii) 2105-4125 (iii) 4126-6106 (iv) 6107-8084.

FIG. 8 shows Table 2 which provides sequences of forward and reverse gene specific primers of gene specific primer pairs. The sequences are set forth in the following SEQ ID Nos: Forward: 8085-9444; Reverse: 9445-10640.

DEFINITIONS

Figure 1:
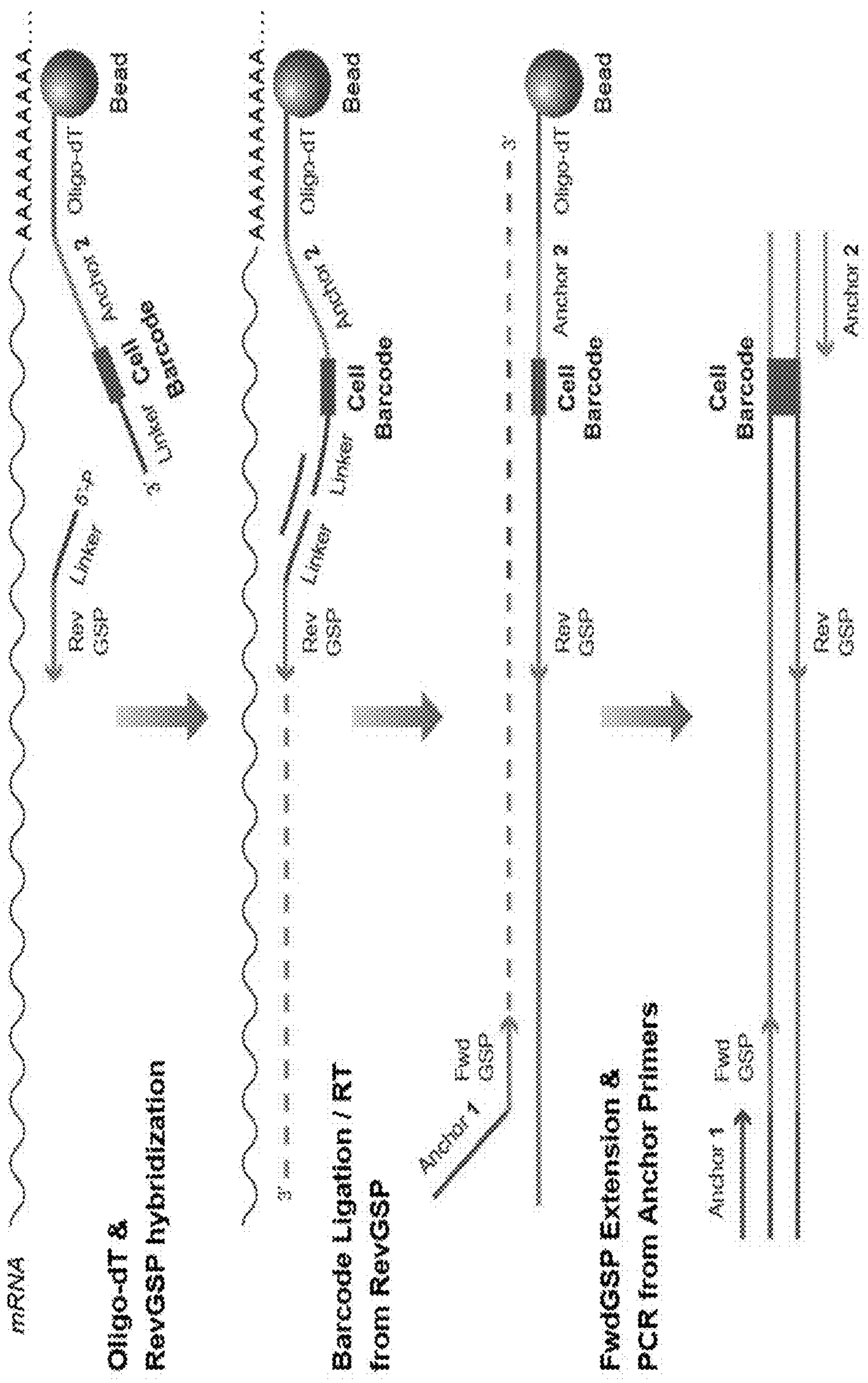
FIG. 1 provides a schematic diagram of a method of preparing a plurality of sample-barcoded anchor-domain-flanked gene specific deoxyribonucleic acid (DNA) fragments in accordance with an embodiment of the invention.

As used herein, the term “hybridization conditions” means conditions in which a primer, or other polynucleotide, specifically hybridizes to a region of a target nucleic acid with which the primer or other polynucleotide shares some complementarity. Whether a primer specifically hybridizes to a target nucleic acid is determined by such factors as the degree of complementarity between the polymer and the target nucleic acid and the temperature at which the hybridization occurs, which may be informed by the melting temperature ($T_M$) of the primer. The melting temperature refers to the temperature at which half of the primer-target nucleic acid duplexes remain hybridized and half of the duplexes dissociate into single strands. The Tm of a duplex may be experimentally determined or predicted using the following formula Tm=81.5+16.6(log 10[Na+])+0.41 (fraction G+C)−(60/N), where N is the chain length and [Na+] is less than 1 M. See Sambrook and Russell (2001; Molecular Cloning: A Laboratory Manual, 3rd ed., Cold Spring Harbor Press, Cold Spring Harbor N.Y., Ch. 10). Other more advanced models that depend on various parameters may also be used to predict Tm of primer/target duplexes depending on various hybridization conditions. Approaches for achieving specific nucleic acid hybridization may be found in, e.g., Tijssen, Laboratory Techniques in Biochemistry and Molecular Biology-Hybridization with Nucleic Acid Probes, part I, chapter 2, “Overview of principles of hybridization and the strategy of nucleic acid probe assays,” Elsevier (1993).

The terms “complementary” and “complementarity” as used herein refer to a nucleotide sequence that base-pairs by non-covalent bonds to all or a region of a target nucleic acid (e.g., a region of the product nucleic acid). In the canonical Watson-Crick base pairing, adenine (A) forms a base pair with thymine (T), as does guanine (G) with cytosine (C) in DNA. In RNA, thymine is replaced by uracil (U). As such, A is complementary to T and G is complementary to C. In RNA, A is complementary to U and vice versa. Typically, “complementary” refers to a nucleotide sequence that is at least partially complementary. The term “complementary” may also encompass duplexes that are fully complementary such that every nucleotide in one strand is complementary to every nucleotide in the other strand in corresponding positions. In certain cases, a nucleotide sequence may be partially complementary to a target, in which not all nucleotides are complementary to every nucleotide in the target nucleic acid in all the corresponding positions. For example, a primer may be perfectly (i.e., 100%) complementary to the target nucleic acid, or the primer and the target nucleic acid may share some degree of complementarity which is less than perfect (e.g., 70%, 75%, 85%, 90%, 95%, 99%).

The percent identity of two nucleotide sequences can be determined by aligning the sequences for optimal comparison purposes (e.g., gaps can be introduced in the sequence of a first sequence for optimal alignment). The nucleotides at corresponding positions are then compared, and the percent identity between the two sequences is a function of the number of identical positions shared by the sequences (i.e., % identity=# of identical positions/total # of positions×100). When a position in one sequence is occupied by the same nucleotide as the corresponding position in the other sequence, then the molecules are identical at that position. A non-limiting example of such a mathematical algorithm is described in Karlin et al., Proc. Natl. Acad. Sci. USA 90:5873-5877 (1993). Such an algorithm is incorporated into the NBLAST and XBLAST programs (version 2.0) as described in Altschul et al., Nucleic Acids Res. 25:389-3402 (1997). When utilizing BLAST and Gapped BLAST programs, the default parameters of the respective programs (e.g., NBLAST) can be used. In one aspect, parameters for sequence comparison can be set at score-100, wordlength=12, or can be varied (e.g., wordlength=5 or wordlength=20).

A "domain" refers to a stretch or length of a nucleic acid made up of a plurality of nucleotides, where the stretch or length provides a defined function to the nucleic acid. Examples of domains include Barcoded Unique Molecular Identifier (BUMI) domains, primer binding domains, hybridization domains, barcode domains (such as source barcode domains), unique molecular identifier (UMI) domains, Next Generation Sequencing (NGS) adaptor domains, NGS indexing domains, etc. In some instances, the terms "domain" and "region" may be used interchangeably, including e.g., where immune receptor chain domains/regions are described, such as e.g., immune receptor constant domains/regions. While the length of a given domain may vary, in some instances the length ranges from 2 to 100 nucleotides (nt), such as 5 to 50 nt, e.g., 5 to 30 nt.

By "primer extension product composition" is meant a nucleic acid composition that includes nucleic acids that are primer extension products. Primer extension products are deoxyribonucleic acids that include a primer domain at the 5' end covalently bonded to a synthesized domain at the 3' end, which synthesized domain is a domain of base residues added by a polymerase mediated reaction to the 3' end of the primer domain in a sequence that is dictated by a template nucleic acid to which the primer domain is hybridized during production of the primer extension product. Primer extension product compositions may include double stranded nucleic acids that include a template nucleic acid strand hybridized to a primer extension product strand, e.g., as described above. The length of the primer extension products and/or double stranded nucleic acids that incorporate the same in the primer extension product compositions may vary, wherein in some instances the nucleic acids have a length ranging from 50 to 1000 nt, such as 60 to 400 nt and including 70 to 250 nt. The number of distinct nucleic acids that differ from each other by sequence in the primer extension product compositions produced via methods of the invention may also vary, ranging in some instances from 10 to 25,000, such as 100 to 20,000 and including 1,000 to 10,000, 10,000 to 20,000, 15,000 to 20,000 and 15,000 to 19,000.

DETAILED DESCRIPTION

Methods of preparing a plurality of sample-barcoded anchor-domain-flanked gene specific deoxyribonucleic acid (DNA) fragments from a template nucleic acid, e.g., ribonucleic acid (RNA), sample are provided. Aspects of the methods include employing a set of gene specific primer pairs, wherein each pair of gene specific primers is made up of a forward primer and a reverse primer, at least one of which includes a sample barcode domain. The methods find use in a variety of different applications, including high-throughput sequencing, e.g., expression profiling, applications, including of small biological samples, e.g., single-cells.

Before the present invention is described in greater detail, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges and are also encompassed within the invention, subject to any specifically excluded limit in the stated range. Where the stated range includes one or both of the limits, ranges excluding either or both of those included limits are also included in the invention.

Certain ranges are presented herein with numerical values being preceded by the term "about." The term "about" is used herein to provide literal support for the exact number that it precedes, as well as a number that is near to or approximately the number that the term precedes. In determining whether a number is near to or approximately a specifically recited number, the near or approximating unrecited number may be a number which, in the context in which it is presented, provides the substantial equivalent of the specifically recited number.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, representative illustrative methods and materials are now described.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present invention is not entitled to antedate such publication by virtue of prior invention. Further, the dates of publication provided may be different from the actual publication dates which may need to be independently confirmed.

It is noted that, as used herein and in the appended claims, the singular forms "a", "an", and "the" include plural referents unless the context clearly dictates otherwise. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

While the apparatus and method has or will be described for the sake of grammatical fluidity with functional explanations, it is to be expressly understood that the claims, unless expressly formulated under 35 U.S.C. § 112, are not to be construed as necessarily limited in any way by the construction of "means" or "steps" limitations, but are to be accorded the full scope of the meaning and equivalents of the definition provided by the claims under the judicial doctrine of equivalents, and in the case where the claims are expressly formulated under 35 U.S.C. § 112 are to be accorded full statutory equivalents under 35 U.S.C. § 112.

In further describing various aspects of the invention, embodiments of various methods will be discussed first in greater detail, followed by a review of various applications in which the methods find use as well as kits that find use in various embodiments of the invention.

Methods

As summarized above, methods of preparing a plurality of sample-barcoded anchor-domain-flanked gene specific deoxyribonucleic acid (DNA) fragments from a ribonucleic acid (RNA) sample are provided. Before describing the methods further, the product nucleic acids prepared the methods is now described first in greater detail.

Sample-Barcoded Anchor-Domain-Flanked Gene Specific DNA Fragments

By "sample-barcoded anchor-domain-flanked gene specific deoxyribonucleic acid (DNA) fragment" is meant a DNA that includes an anchor domain on each side of a gene specific domain. As the gene specific domain is flanked by anchor domains, the DNA fragments prepared by methods of the invention include a first anchor domain located at a first end of the DNA fragment and a second anchor domain located at a second end of the DNA.

By gene specific domain is meant a region of the dsDNA fragment the includes a sequence found in template nucleic acid, such as a template mRNA. While the length of the gene specific domain may vary, in some instances the gene-specific domain ranges in length from 50 to 500 nt, such as 60 to 300 nt.

In addition to the gene specific domains, as described above, the DNA fragments have anchor domains on either side of the gene specific domain. Anchor domains are domains that are employed in nucleic acid amplification, such as polymerase chain reaction (PCR), steps of the methods, where they serve as primer binding sites for the primers employed in such amplification steps. Where the amplification employed is PCR, the anchor domains may also be referred to as PCR primer binding domains. The length of the anchor domains may vary, as desired. In some instances, the anchor domains of each primer pair range in length from 10 to 50 nt, such as 10 to 30 nt, e.g., 10 to 24, including 12 to 20 nt. Where desired, the anchor domains may include PCR suppression sequences. PCR suppression sequences are sequences configured to suppress the formation of non-target DNA during PCR amplification reactions, e.g., via the production of pan-like structures. Such sequences, when present, may vary in length, ranging in some instances from 5 to 25 nt, such as 7 to 21, including 7 to 20 nt. PCR suppression sequences of interest include, but are not limited to, those sequences described in U.S. Pat. No. 5,565,340; the disclosure of which is herein incorporated by references. An example of forward and reverse anchor domains that include PCR suppression sequences are: AGCACCGACCAGCAGACA (SEQ ID NO:01) and AGACACGACCAGCCACGA (SEQ ID NO:02).

As summarized above, the DNA fragments are also "sample-barcoded", by which is meant that they include a barcode domain that denotes, i.e., indicates or provides information about (such that it may be used to determine), the specific sample, e.g., cell, from which the fragment has been produced. Barcode domains include unique, specific sequences. While the length of a given barcode domain may vary, in some instances the length ranges from 6 to 30 nt, such as 8 to 20 nt, and including 12 to 18 nt. Examples of suitable sequences for 18 nt long barcode domains are provided in Table 1 in FIG. 7.

In addition to the gene-specific, barcode and anchor domains, the fragments produced by methods of the invention may further include a unique molecular index (i.e., unique molecular identifier or UMI) domain. UMI domains have sequences configured for labeling of the each in the plurality of RNA molecules (and extended cDNA product) present in the hybridization mix with different molecule-specific indexes. UMI domains are stretches of random or semi-random nucleotides. While the lengths of UMI domains may vary, in some instances the length of a UMI domain ranges from 8 to 20 nt, which in a given assay provides for complexity of different unique sequences of 10,000 or more different UMIs. In some instances, using at least 10,000 unique indexes is sufficient to label each template molecule with the same sequence with a unique index, i.e., UMI. By analyzing the number of the indexes, e.g., via NGS, the number of each unique template molecule with the same sequence employed in multiplex PCR assay can be calculated. In some instances, the UMI domain may be combined with the barcode domain, e.g., where the UMI nucleotides are interspersed with the barcode nucleotides in a BUMI domain, e.g., as described in United States Patent Application Publication No. US20150072344, the disclosure of which is herein incorporated by reference.

Also present in the DNA fragments produced by methods of the invention may be ligated linker domains. Ligated linker domains are domains having sequences found in first and second linker domains employed in methods of the invention, e.g., as described in greater detail below. In the ligated linker domain, the sequences of the first and second linker domains are joined to each other, such that the sequence of one of the linker domains begins at the end of the other linker domain. The length of the ligated linker domain may vary, and in some instances ranges 15 to 60 nt, such as 20 to 50 nt, and including 24 to 40 nt. While not required, in some cases the ligated linker domain has a sequence with a GC-content in the range 50% to 80%.

As indicated above, the methods are methods of preparing a plurality of sample-barcoded anchor-domain-flanked gene specific DNA fragments from a template nucleic acid sample, e.g., a template ribonucleic acid (template RNA) sample. More specifically the methods are multiplex methods of preparing a plurality of sample-barcoded anchor-domain-flanked gene specific deoxyribonucleic acid DNA fragments from a template nucleic acid, e.g., RNA, sample, such that each DNA fragment of the plurality is produced at the same time from the RNA sample, e.g., each DNA fragment is produced simultaneously from the source RNA sample. The number of distinct DNA fragments prepared in a given method may vary, where in some instances the number in the plurality ranges from 10 to 25,000, such as 100 to 20,000 and including 1,000 to 10,000, 10,000 to 20,000, 15,000 to 20,000 and 15,000 to 19,000.

Among the DNA fragments of the plurality that are produced from a single sample by methods of the invention, a given DNA fragment is considered to be distinct from another DNA fragment if the gene-specific domains of the two fragments differ from each other by sequence. While the gene-specific domains of the DNA fragments in a given plurality may all differ from each other, e.g., because they include coding sequences of different genes, the DNA fragments will also include common domains, i.e., domains that are identical to each other (i.e., domains having sequences that do not differ from each other), where these domains are the flanking anchor domains, the barcode domains and the ligation linker domains. When employed, the DNA fragments may further differ with respect to additional domains, such as distinct UMI domains, such that the UMI domains of the DNA fragments have different sequences, i.e., they are not common or identical.

As indicated above, during a given protocol a plurality of DNA fragments produced from one sample may be combined, i.e., pooled, with one or more additional pluralities produced from one or more additional samples. In such pooled compositions, each plurality of the pooled composition will have a distinct barcode domain, such that the barcode domain of a first plurality of the composition will have a sequence that differs from every other barcode domain of every other plurality in the pooled composition. In a given pooled composition, each barcode domain has a sequence that is significantly different from that of any other barcode domain in the pooled composition, with a difference of at least 1 nucleotide, such as 2 nucleotides and including 3 or more nucleotide differences in the whole set of barcodes employed in the assay. In this way each plurality of the pooled composition will have a distinct identifying barcode domain. The number of different barcode domains in such pooled compositions is the same as the number of different pluralities in the pooled composition, where the number represents the number of different samples that is employed to make the pooled composition. The number of different barcodes present in a given pooled composition depends on number of samples being analyzed in a given assay. In some instances, the number ranges from 10 to 1,000,000, such as 100 to 100,000, and including 1,000 to 10,000. For example, currently for analysis of single-cell samples, the number of barcodes may be 10,000 or more, but for analysis of clinical samples the number of barcodes may not exceed 1,000.

Gene Specific Primers

As summarized above, in embodiments of the invention a set of gene specific primers, i.e., a collection of gene specific primer pairs of known sequence, is employed. While the number of primer pairs in a given set may vary, as desired, in some instances the number of primer pairs in a given set is 10 or more, such as 20 or more, 30 or more, 40 or more, 50 or more, 60 or more, 70 or more, 80 or more, 90 or more, 100 or more, 125 or more, 250 or more, 500 or more, including 1000 or more, 200 or more, 5000 or more, 8000 or more, 10,000 or more 15,000 or more, 18,000 or more and 20,000 or more. In some instances, the number of gene specific primer pairs that is present in the set is 25,000 or less, such as 20,000 or less. As such, in some embodiments the number of gene specific primer pairs in the set that is employed in the methods ranges from 10 to 25,000, such as 50 to 20,000, including 1,000 to 10,000, e.g., 2,500 to 8,500, and 10,000 to 20,000, e.g., 15,000 to 19,000.

Gene specific primer pairs present in a given set of the invention are made up of a forward primer and a reverse primer, wherein the forward and reverse primers of each primer pair include gene specific domains, where these gene specific domains may be experimentally validated as suitable for use in a multiplex amplification assay. By "experimentally validated as suitable for use in a multiplex amplification assay" is meant that the set of primers for each target gene in a given set has been experimentally tested in a multiplex amplification assay, such as described in U.S. patent application Ser. No. 15/133,184 published as US-2016-0376664-A1 and U.S. application Ser. No. 15/914,895 published as US-2018-0245164-A1 (the disclosures of which are herein incorporated by reference), and the best performing primer set is selected based on parameters, e.g., one or more functional parameters, e.g., as described in greater detail below. While the multiplex amplification assay employed to experimentally validate a set of primers may vary, in some instances the protocol employed includes a first step of, for each target gene selected from the genome-wide set of human or mouse genes, selecting a region that is conservative for different mRNA isoforms, following which a set of forward and reverse PCR primers which are complementary and specific for the selected gene region are designed. The primers may be designed using any convenient algorithm and/or software tool, e.g., such as the Primer3 algorithm, Primer Design Tool from NCI, etc. The melting temperature of the selected primers may vary, ranging in some instances from 60° C. to 80° C., such as 65° C. to 80° C. Furthermore, the primers may be selected that lack significant secondary structures, or self-complementarity (e.g., primers may be selected with less than 4-bp complementary regions) and cross-complementarity to each other of less than 10 nt complementarity region. The length of the selected PCR primers may vary, and in some instances ranges from 15 to 25 nt, such as 16 to 24 nt, with GC-content of between 45% to 85%, such as 50% to 75%. In order to avoid primer/dimer formation in a multiplex RT-PCR assay, the selected primers in some embodiments are designed with the nucleotide A at the 3'-end and biased GCA-rich composition with reduced percentage of T nucleotides, where in some instances the percentage of T is 20% or less, such as 15% or less, including 10% or less, down to 0%. Following primer design, homology searching for similar PCR primer binding domain(s) in other RNA species (such as available in GeneBank), e.g., via BLAST or Thermo-Blast algorithm, is performed in order to select primers specific only to the target region of interest. Next, the resultant primer set is ranked based on the distance between primers with the preferred size of amplicons, e.g., which ranges in some instances between 60 to 250 base pairs (bp). Following this ranking, a set of at least 1 primer pair, such as 3 or more, e.g., 5 or more, up to 12 or more, but in some instances not exceeding 12 primer pairs, is synthesized and functionally validated in a multiplex Reverse Transcription (RT)-PCR-NGS (next generation sequencing) assay, e.g., using the protocol disclosed in the Experimental section, below. In some embodiments, e.g., those specific for mutation profiling in clinically actionable or cancer driver genes, a complete set of PCR primers is designed and validated which allows one to amplify a set of overlapping amplicons that cover the complete mRNA sequence from the 5' to the 3'-end. Primers present in sets of gene specific primers of the invention may be experimentally validated using any convenient protocol. In some instances, the experimentally validated gene specific domains are validated in a multiplex amplification assay with a synthetic control template mix which mimics the natural target template sequences and includes binding sites for the whole set of gene-specific primer pairs and/or a universal natural template mix derived from multiple different mammalian tissues or cell types. Specifically, as a template for multiplex RT-PCR assay, a set (usually between 3 to 6) of natural total universal RNAs, e.g., including a mix of several RNAs isolated from human or mouse cell lines or tissue samples (e.g., available from Takara-Clontech, Agilent, Qiagen, Origene, etc.) may be employed as a natural nucleic acid control. In addition (or alternatively) to the set of the natural control template nucleic acids, a mix of the synthetic control template nucleic acids, e.g., one that has been synthesized on the surface of custom microarrays (e.g., Custom Array or Agilent) and designed for each target amplicon, may be employed. In such synthetic control templates, the templates include the sequence of the both PCR primer-binding site domains and the full-length or truncated in the middle cDNA region between PCR primers that corresponds to the primer extension domain. In some functional validation assays, two synthetic template concentrations (e.g., 10-fold difference) may be employed to measure expression level (number of specific reads) in a manner that is not dependent on the amount of starting universal RNA template. The length of synthetic control templates may vary, ranging in some instances from 100 to 200, such as 110 to 180, including 120 to 160 nt. The amplification products generated in the multiplex RT-PCR assays may be quantitatively analyzed by sequence analysis using conventional NGS instruments (e.g., available from Illumina, Thermo-Fisher, Nanopore and other commercial vendors). The NGS data generated for different templates and experimental conditions may be scaled to the same number of total reads (usually total 10,000,000 reads), aligned with the sequences of PCR primer domain and downstream extended domain sequences for each target amplicon. The number of specific reads corresponding to each target amplicon may be measured as the number of correctly aligned sequences for each PCR primer pair and downstream extended domain sequences. In addition, for each primer pair, the number of non-specific (off-target) reads for the amplicons may be calculated which has correct the PCR primer domain but different, non-target extended domain sequences. The set of PCR primer pairs designed for each target gene may then be ranked using the set of criteria described below. The highest rank PCR primer pair for each target gene is first selected based on the highest number of specific reads (e.g., 100 or more, such as 500 or more and including 1,000 specific reads) and minimum number of non-specific reads (e.g., 2-fold less than number of specific reads, but not exceeding 5,000, or such as 2,000 reads) measured across all universal RNAs and control synthetic template. Next, the highest activity PCR primer set may be selected from among other primers that demonstrate a common pattern of expression among different natural universal RNAs used in the assay. Common pattern of expression between different primers sets indicates that they target the same conservative cDNA region, rather than a unique target region specific for particular mRNA isoform(s). In some embodiments, human PCR primers are selected that effectively amplified target regions from human but not from the mouse universal RNAs. In other embodiments, e.g., those specific for detection of clinically actionable mutations, not one but a complete set of PCR primers are selected which amplify amplicons overlapping the whole mRNA/cDNA sequence. In some embodiments, specific activity of primers is assayed at thermocycling extension temperatures of both 60° C. and 65° C. Using these two different conditions enables the identification of primer pairs that demonstrate similar (e.g., less than 2-fold difference) specific activity across several control templates and universal RNAs. In some instances, if a PCR primer set with high specific activity in both control synthetic template (e.g., less than 500 reads) and in all universal RNAs (e.g., less than 100 reads) for any target gene is not identified, a new candidate PCR primer set for the failed gene(s) is designed and validation protocol repeated until a suitable set is found. As a result of functional validation experiments, one can select at least one PCR primer set for each target gene of interest that has high sensitivity and selectivity, e.g., for at least 90%, such as 95% or more target genes of interest.

Each pair of gene specific primers are configured to hybridize to a target nucleic acid sequence for which they are specific at locations that are separated by a known or predetermined distance, i.e., a template distance. The length of the template distance may vary, ranging in some instances from 50 to 750 bp, such as 60 to 500 bp, including 60 to 300 bp, e.g., 70 to 250 bp. As such, the product nucleic acid produced from the gene specific primers may have a central domain, i.e., extension domain, complementary to the template nucleic acid from which it is produced (that is, identical to the reverse-complement sequence of the template nucleic acid from which it is produced) that varies in length, ranging in some instances from 50 to 750 nt, such as 60 to 500 nt, including 60 to 400 nt, e.g., 60 to 300 nt, including 80 to 200 nt.

A given gene specific primer may include a multiplex experimentally validated gene specific domain, e.g., as described above. The length of the gene specific domain may vary, so long as the domain serves to specifically hybridize to a target nucleic acid under hybridization conditions of interest. An example of such hybridization conditions is hybridization at 50° C. or higher and 0.1×SSC (15 mM sodium chloride/1.5 mM sodium citrate). In some embodiments, these hybridization conditions may be defined by length and nucleotide sequence of the gene-specific domains of the PCR primers, composition of PCR buffer, properties of DNA polymerase and conditions used in the primer extension step. Furthermore, hybridization conditions could be compatible with primer extension conditions, e.g., where both hybridization and extension step performed in DNA polymerase reaction buffer (e.g. 1×HF or 1×GC buffer from Thermo-Fisher). In another embodiment, where the hybridization step and primer extension step are separate steps in the protocol, the hybridization buffers could contain additional components for increasing hybridization rate (e.g., CTAB, PEG, high salt concentration (e.g., 1M or more), etc.), lysing the cells, denaturing proteins, stabilizing RNA, protein (detergents, guanidium salts, urea, PMSF, 2-mercapoethanol, etc.). If reverse barcoded primers are hybridized with target template RNA composition in cell extracts (e.g., single cells), the hybridization buffer could be optimized by highly denaturing conditions to stabilize the RNA. Furthermore, the reverse barcoded primers may be longer (such as 25-80 nt, such as 30 to 70 nt) than regular PCR primers to facilitate highly specific and stable interaction with target RNAs at elevated temperatures (e.g., 50° C. to 80° C.). Furthermore, the use of stringent hybridization conditions and the removal of non-binding primers permits the formation of specific complexes between reverse gene specific primers and target RNAs. Therefore, the specificity of extension of reverse barcoded primers could be significantly defined by hybridization rather than follow-up primer extension step specificity. Primer extensions temperatures may vary, ranging in some instances from 50 to 75, such as 60 to 72° C. As disclosed in Experimental section below, in one of the embodiments a primer extension step is employed in which extension occurs between 60 and 65° C. using Phusion II DNA polymerase, HF or GC buffer reagents available from Thermo-Fisher. Both the length and the specific nucleotide sequence of the PCR primers define the hybridization condition at the primer extension step. In some embodiments, the length and specific sequence of the gene specific domains of the PCR primers is selected in order to provide efficient binding and extension at 60 and 65° C. under the PCR conditions used in the primer extension step. Such conditions may provide or high efficiency and specificity of the primer extension in PCR reaction conditions. In some embodiments, the primer length and sequence may be adjusted to perform an extension step at 68° C. or even 72° C.

To control efficiency and specificity of primer extension step, the length of the gene specific domain of the forward and reverse primers may vary. In some instances, the length ranges from 10 to 80 nt, such as 15 to 75 nt, e.g., 10 to 50 nt, such as 10 to 30 nt, including 14 to 22 nt or 16 to 24 nt. The gene specific domain of the forward and reverse primers may vary length. In some instances, the gene specific domain of the forward domains is shorter than the gene specific domain of the reverse primers. For example, in some instance the length of the gene specific domain in the forward primers ranges from 15 to 30 nt, such as 18 to 25 nt, while the length of the gene specific domain in the reverse primers ranges from 25 to 80 nt, such as 30 to 70 nt, including 30 to 50 nt. Each primer of the gene specific primer set may include only a gene specific domain, or may include one or more additional domains as desired, e.g., anchor domains, NGS adaptor domains, labels or label domains, etc., e.g., as described below. In some embodiments where additional domains are present, each primer pair may include primers ranging in length from 10 to 150 nt, such as 10 to 100 nt, including 10 to 75 nt, such as from 15 to 60 nt, including from 24 to 45 nt.

Where desired, the gene-specific primer domain of each primer is GCA- and/or GCT-rich. By GCA- and/or GCT-rich is meant that the gene-specific primer domain has a substantial portion of G, C, A- and/or G, C, T nucleotides. While the number of such nucleotides in a gene specific primer domain may vary, in some instance the number of such sequences ranges from 75% to 100%, such as 85% to 100%. As the gene specific primer domains of such embodiments are GCA- and/or GCT-rich, the GC content of the gene specific primer domains is also high. While the GC content may vary, in some instances the GC content ranges from 40 to 90%, such as 45 to 85%, including 50 to 85%, e.g., 50 to 80%.

Depending on the specific application for which the set is configured, the set of gene specific primers may be configured to target a wide range of mammalian genes, and pathogenic genes from a wide range of pathogenic organisms, such as viruses, bacteria, fungi, etc. which could be present in the human or mammalian bodies. Of interest in certain applications are human, mammalian species commonly used as a model organisms to study human diseases, such as mouse, rat, or monkey, and pathogenic organisms associated with human diseases. To be analyzed in accordance with embodiments of the invention, the targeted genes may be present in the mammalian cells or fluids. In some embodiments, the targeted genes are may be protein coding, or may express non-coding RNAs, micro RNAs, mitochondrial RNAs, regulatory RNAs, etc. In some instances, the set of genes selected is genome-wide, such that it covers all genes present in the genome of an organism. In other embodiments, the genes are selected from the genes that could be transcribed or expressed in the organism and present in the biological samples in the form of RNA. The genome-wide set of genes specific for human, model and pathogenic organisms is of special interest in some instances and may be used to develop a set of genome-wide targeted RNA expression assays based on the disclosed multiplex PCR assay. Genome-wide sets of PCR primers may vary in number, and in some instances are configured to assay 18,000 or more, such as 20,000 or more and 25,000 or more, such as 30,000 or more genes. Additional sets of PCR primers may be configured based on a genome-wide set of genes from a wide range of viral, bacterial and eukaryotic pathogenic organisms. In another embodiment, the set of gene specific primers may be configured to produce primer extension products from a subset of specific genes selected from the genome-wide set of genes. One of these subsets is the set of cancer associated genes, that is, the genes that have been shown to be associated with initiation, development, diagnostic, treatment of cancer. Such genes could be implicated in, or be diagnostic of, or otherwise of interest in, the study and/or treatment of cancer, i.e., any of various malignant neoplasms characterized by the proliferation of anaplastic cells that tend to invade surrounding tissue and metastasize to new body sites. As such, cancer associated genes that may be represented in a given set of gene specific primers include, but are not limited to: cancer hallmark genes, pan-cancer driver genes, pathway and signaling network genes, drug metabolism genes, extracellular proteome genes, drug target genes (including those of FDA approved and/or clinical trial targets), cell lineage genes, immunity mechanisms & immunotherapy markers, immunotherapy drug target genes, known biomarkers, epigenetics genes, etc.

In another embodiment, the subset of the cancer associated genes is employed in developing of Cancer Clinically Actionable 26 assay for profiling all clinically actionable mutations in the set of 26 human genes (ABL1, AKT1, ALK, BRAF, CDK4, CDK6, CDKN2A, EGFR, ERBB2, FGFR1, FGFR2, FLT3, KDR, KIT, KRA, MET, NRAS, PDGFRA, PIK3CA, PIK3R1, PTCH1, PTEN, PTPN11, RET, ROS1, SMO). This assay includes the additional set of multiplex PCR primers designed and validated to amplify the set of overlapping amplicons that cover the whole mRNA sequence of the target genes.

In another embodiment, the multiplex PCR assay is designed for analysis of a subset of cell-specific, tissue-specific or state-specific genes. These genes encode marker products (e.g. proteins, peptides or RNAs) that are specifically expressed in different cell types (e.g. markers for T, B, NK, stromal, cancer, epithelial, neuronal, etc. cells), different tissues or different cell states, e.g. marker products induced by treatment (e.g. drugs) or changes in conditions (e.g. heat shock), disease states (e.g. cancer, infection), or natural biological processes (e.g. differentiation, apoptosis, aging, etc.). The development of multiplex PCR assay, based on the set of gene-specific primers specific for the marker genes, may be employed in the development of prognostic and predictive clinical diagnostic tools, profiling different cell types and their phenotypes in normal and disease states. For a marker gene analysis assay, the set of gene specific primer pairs includes primers configured to produce primer extension products for 10 or more genes listed in Table 2 (FIG. 8). As such, the set of gene specific primers employed in a given method may represent at least some of the genes listed in Table 2(FIG. 8), such that the set may include primer pairs that correspond to at least some of the genes listed in Table 2(FIG. 8).

A primer pair is considered to correspond to a given gene if the primers of the pair specifically hybridize to sequences of the gene. It is understood based on the current prior-art knowledge, the selected primer pair sequences could include all or only portion of the primer sequences (e.g. disclosed in the Table 2(FIG. 8)), so long as they provide for the desired gene specificity. Modification in the specific sequences of the PCR primers, such as mutations, deletion, extensions, using nucleotide analogs, etc., may be present so long as the functionality of the primers in the primer extension step is maintained. The number of genes from Table 2(FIG. 8) represented in the set of gene specific primers may vary, ranging from 10 to 10,000, including 25 to 10,000, 50 to 10,000, 100 to 10,000, where in some instances the number is 150 or more, such as 200 or more, 250 or more, 500 or more, 1,000 or more, up to and including all of the genes listed in Table 2. In some instances, the set of gene specific primers includes primer pairs having gene specific sequences listed in Table 2(FIG. 8). The number of gene specific primer pairs having gene specific sequences listed in Table 2(FIG. 8) that may be present in a given set of gene specific primers may vary, where in some instances the number ranges from 10 to 10,000, including 25 to 10,000, 50 to 10,000, 100 to 10,000, where in some instances the number is 150 or more, such as 200 or more, 250 or more, 500 or more, 1,000 or more, up to and including all of the primer pairs listed in Table 2. Subsets of the genes listed in Table 2 that may be employed in a given assay may vary. Specific subsets of interest that may be employed in a given assay include but are not limited to: cell-specific markers, disease-specific markers, tissue-specific markers, or any specific set of genes selected based on specific functions, expression, or association with human diseases, and the like. Essentially any combination of primers, including all the primers, identified by the sequence identifiers provided in Table 2(FIG. 8) may be assembled to form a set or subset of primer pairs of the present disclosure.

Sets and subsets of primer pairs may be configured to include or exclude multiple primer pairs for a particular gene. For example, a set or subset of primer pairs may include no or essentially no two or more primer pairs that target the same gene. Correspondingly, a set or subset of primer pairs may include two or more different primer pairs that target the same gene. Where two or more primer pairs for a particular gene are included in a set or subset, the primer pairs may or may not share the same forward primer or the same reverse primer. For example, in some instances, two primer pairs for a single gene may include the same forward primer but have different reverse primers, the same reverse primer but have different forward primers, or have different forward primers and different reverse primers.

As described above, in some instances, a set or subset of primer pairs may be configured such that no two primer pairs target the same gene, i.e., there is only one primer pair for each gene included in the set or subset. In some instances, the number of different primer pairs targeting the same gene may be low, including but not limited to e.g., 10 or less primer pairs targeting each gene of the set or subset, such as 5 or less, 4 or less, 3 or less or no more than 2 primer pairs targeting each gene of the genes of a set or subset. In some instances, 10% or less of the genes of a set or subset may be targeted by more than one primer pair, including 8% or less, 7% or less, 5% or less, 3% or less, 2% or less and 1% or less.

In some instances, the methods include selecting the set of gene specific primers from a provided master library of gene specific primers, e.g., choosing a subset of primer pairs from an initial collection of primer pairs. For example, the methods may include selecting a subset of primer pairs (and thereby identify the primer pairs of a set of gene specific primers to be employed in methods of the invention, such as described above) that correspond to genes from Table 2, where the number of primer pairs in the selected subset may vary, ranging in some instances from 10 to 10,000, including 25 to 10,000, 50 to 10,000, 100 to 10,000, where in some instances the number is 150 or more, such as 200 or more, 250 or more, 500 or more, 1,000 or more.

The disparate primer pairs of a given set are present in substantially the same, if not the same amount. As such, in some instances, the copy number of any given primer pair in a set does not vary from the copy number of any other primer pair of the set by a value of 100% or less, such as 50% or less. A given primer pair may be present in a set in any desired amount, where in some instances the amount ranges from 1% to 1000%, such as 5% to 500%, or 10% to 500%. The final concentration of each primer in the primer extension step may vary, and in some instances ranges from 0.01 to 50 nM, such as 0.01 to 20 nM, or 0.01 to 10 nM, where examples of specific concentrations of interest include 0.01 nM, 0.1 nM, 1 nM, 2 nM, 5 nM, 10 nM, 20 nM and 50 nM.

The sets of gene specific primers, e.g., as described above, are non-naturally occurring compositions. In some instances, the sets of gene specific primers include domains or regions that are not naturally occurring sequences and/or are not naturally joined to the gene specific primer domains in naturally occurring nucleic acids. For example, the gene specific domains may be joined to one or more synthetic domains, e.g., universal primer binding site domains, indexing domains, barcode domains, adaptor domains, anchor domain, linker domain, etc. In some instance the gene specific primers may include one or more moieties that are not present in naturally occurring nucleic acids, e.g., label moieties (e.g., directly detectable labels, such as fluorescent labels, indirectly detectable labels, e.g., components of a signal producing system, etc.), non-naturally occurring nucleotides, etc.

Depending on the particular protocol, the forward and reverse primers of the pairs of the sets of gene specific primers may be used together or separately. As such, a given method may include using the forward and reverse primer subsets of a given set separately, such as in methods where a template composition is first contacted with a subset of the reverse primers of a set, and then contacted with a subset of the forward primers of the set. Alternatively, a given method may include contacting a template both the forward and reverse primer subsets of a given set of gene specific primers at the same time.

The methods of the invention are characterized by employing a set of gene specific primer pairs, wherein each pair of gene specific primers is made up of a forward primer and a reverse primer and at least one of the forward and reverse primers includes, at some time during the method, a sample barcode domain. In some instances, the methods are characterized by employing: a sample-barcoded donor nucleic acid that includes an anchor domain and a sample barcode domain, wherein the sample-barcoded donor nucleic acid is employed in conjunction with a set of gene specific primer pairs, wherein each pair of gene specific primers is made up of a forward primer and a reverse primer and the methods include transferring at least the sample barcode domain to one of the forward and reverse primers. In other instances, the methods are characterized by employing a set of gene specific primers in which the reverse primers include a sample barcode domain.

Sample-Barcoded Donor Nucleic Acid Mediated Protocols

A sample-barcoded donor nucleic acid is an initial nucleic acid from which the sample barcoded domain of the DNA fragments is derived. In other words, the sample-barcoded donor nucleic acid serves as the source of the barcode domain of the final sample barcoded DNA fragments. Since the sample-barcoded donor nucleic acid serves as the source of the sample barcode domain, the sample barcode domain does not need to be incorporated into any of the gene specific primers employed to produce gene specific fragments from a template nucleic acid sample. A sample-barcoded donor nucleic acid includes a sample barcode domain and an anchor domain, e.g., as described above. In addition, a give sample-barcoded donor nucleic acid may include a linker domain and/or a UMI domain, e.g., as described above.

In some instances, the donor nucleic acid includes a capture domain. In some such instances, the sample-barcoded donor nucleic acid includes a template, e.g., an RNA, template-binding or capture domain, an anchor domain, and a barcode domain, and optionally a linker domain and/or a UMI domain. The template-binding domain is the sequence necessary for binding barcoded oligonucleotide to template, like DNA or RNA. Examples of template-binding domains include but are not limited to oligo dT sequences, e.g., for binding to polyA tails of mRNA molecules with number of dT nucleotides between 15 to 35, random oligonucleotides with a length of randomly synthesized A, T, G or C between 6 to 30 nucleotides, or semi-random oligonucleotides with length between 6 to 18 nucleotides designed against conservative regions in target templates, e.g. stretches of the nucleotides coding triplets for the most abundant amino acids, splicing sites, etc. Where the target RNA template molecule is mRNA, the RNA binding domain may be a poly dT sequence that hybridizes to the mRNA polyA tail. The length of the RNA binding domain may vary, and in some instances ranges from 10 to 40 nt, such as 15 to 35 nt, including 20 to 30 nt. The linker domain is a domain having a sequence configured for binding and/or ligation with linker domain present in another component of the assay, such as a gene specific primer, e.g., as described below. While the length of a given linker domain may vary, in some instances the length ranges from 5 to 30 nt, such as 10 to 25 nt, including 12 to 20 nt. There are no special requirements for nucleotide composition or sequence of the linker domain, but in some instances the linker domain is selected with GC-content in the range 50% to 80% without significant secondary structure within the domain or with other domains present in the oligonucleotide. In addition to the RNA binding domain, the anchor domain, barcode domain and linker domain, the donor nucleic acid may also include a UMI domain, e.g., as described above. In such instances, a given assay may employ a plurality of donor nucleic acids that have common RNA binding, anchor, barcode and linker domains but distinct UMI domains that differ from each other in terms of sequence. In such instances, the number of different donor nucleic acids that differ from each other in terms of their UMI domains, and in some instances solely in terms of their UMI domains, employed with a given RNA sample may vary, and in some instances may range from 1,000 to 20,000, such as 5,000 to 10,000.

The donor nucleic acids employed in methods of the invention may be in solution or bound to the surface of a solid phase, as desired. When bound to a surface of a solid phase (i.e., solid support), the donor nucleic acids may be covalently bound or non-covalently bound. The solid phase may vary, where examples of solid phases include, but are not limited to, beads, wells, plates, etc., e.g., made of a suitable solid phase material, such as a polymeric material, where the surface is configured to provide the desired bond to the donor nucleic acids.

In the sample barcoded donor nucleic acids employed in methods of the invention, the order of the different domains may vary. Accordingly, in some embodiments a sample-barcoded donor nucleic acid may have the structure: 3'-linker 1-sample barcode domain-anchor 2 domain-RNA binding domain-5'. In yet other embodiments, the sample-barcoded donor nucleic acid comprises the structure: 3'-RNA binding domain-anchor 1 domain-sample barcode domain-linker 1 domain-5'. These various donor nucleic acids and the protocols in which they find use are further described below.

With respect to donor nucleic acid mediated embodiments, in some instances, additional domains present among a given pair of forward and reverse gene specific primers are a linker and anchor domains. In some instances, the forward gene specific primer includes an anchor domain and the reverse gene specific primer includes a linker domain. In such instances, the forward primers may have the structure 5'-anchor 1-forward gene specific primer (GSP) domain-3' and the reverse primers have the structure: 3'-reverse GSP domain-linker 2-5'. In other instances, the forward gene specific primer includes a linker domain and the reverse gene specific primer includes an anchor domain. In such instances, the forward primers may have the structure: 3'-forward GSP domain-linker 2-5'; and the reverse primers may have the structure 5'-anchor 2-reverse GSP domain-3'.

In some instances, a reverse GSP mediated barcoding protocol is employed. In these embodiments, a sample-specific barcode is ligated to a plurality of different gene-specific primers hybridized to template nucleic acids, e.g., template RNAs, such as template mRNAs, where the GSPs may or may not be extended in a first round primer extension reaction, such as a first round of cDNA synthesis (i.e., a reverse transcription), at the time of ligation. As a result, the reverse GSPs and/or their primer extension, e.g., first strand cDNA, products include a sample-specific barcode domain which originates from the donor nucleic acid. In other words, the sample-specific barcodes are transferred from an initial sample barcoded donor nucleic acids to reverse gene-specific primers that are hybridized to template nucleic acids, such as RNA template molecules, e.g., mRNA. Accordingly, these embodiments may be characterized in that the reverse GSPs are employed in the first strand synthesis step and the sample barcode domain and anchor domain of the donor nucleic acid is ligated to the reverse GSPs such that these domains are incorporated into the first strand synthesis products. A schematic illustration of an embodiment of this protocol is illustrated in FIG. 1.

In the embodiment illustrated in FIG. 1, a sample barcode initially present in a donor nucleic acid is transferred to a reverse GSP during first strand cDNA synthesis from an mRNA template. As shown in FIG. 1, the sample-barcoded donor nucleic acid has the structure: 3-linker 1-sample barcode domain-anchor 2 domain-RNA binding domain-5'. The 5' end of the donor nucleic acid is bonded to a solid support, and specifically a bead. Also, as illustrated, the reverse GSPs include the structure: 3'-reverse GSP domain-linker 2-5'. In the first step of the protocol illustrated in FIG. 1, the donor nucleic acids and Rev GSPs are combined with the sample ribonucleic acids, e.g., an mRNA sample obtained from a single cell, under hybridization conditions such that the donor nucleic acids bind to the polyA tails of the mRNAs and the GSPs bind to their complementary domains of the mRNAs. Where desired, the resultant mRNA template/GSP/RT Primer complexes may be purified from any excess of unbound gene-specific primers and donor nucleic acids. In the illustrated embodiment shown in FIG. 1, the resultant complexes are immobilized on beads and can be purified from any excess of non-hybridized gene-specific primers using a convenient washing protocol, such as washing protocols known in the art. Alternatively, any excess of unbound oligonucleotides may be removed using other purification protocols, such as but not limited to: nuclease treatment, chromatography, size-dependent binding to specific matrix, e.g. AMPure beads, etc.

Following hybridization of the GSPs and the donor nucleic acids to the mRNAs of the sample, the linker 1 and linker 2 domains of hybridized sample-barcoded donor nucleic acids and GSPs are ligated to produce sample-barcoded reverse primers, e.g., as illustrated in FIG. 1. To provide for sufficient proximity of the ends of the linker domains, a ligation linker may be employed. The ligation linker is an oligonucleotide that includes a first domain complementary to the linker 1 domain of the donor nucleic acid and a second domain complementary to the linker 2 domain of the donor nucleic acid. When employed, the length of the ligated linker may vary, and in some instances ranges 15 to 60 nt, such as 20 to 50 nt, and including 24 to 40 nt. While not required, in some cases the ligation linker domain has a sequence with a GC-content in the range 50% to 80%. The linker 1 and linker 2 domains may be ligated to each other using any convenient DNA ligase, where DNA ligases that may be employed include, but are not limited to: DNA ligases, e.g., Ampligase® Thermostable DNA Ligase, CircLigase-DNA Ligase, *E. coli* DNA ligase, T3 DNA ligase, T4 DNA ligase, T7 DNA ligase, Taq DNA ligase, and the like.

In the embodiment illustrated in FIG. 1, following ligation to produce sample-barcoded reverse GSPs, the methods include reverse transcribing first strand cDNA molecules from the sample-barcoded reverse primers. Reverse transcription may be accomplished by contacting the template RNA/sample-barcoded reverse GSP complexes with a reverse transcriptase under reverse transcription conditions, e.g., as described in greater detail below. Reverse transcription results in the production of a population of GSP primer extension products having a sample barcode domain and an anchor domain at their 5' ends. Where desired, the donor nucleic acids may include a linker domain at the 3'-end that provides for ligation to the linker of the gene-specific primer but that cannot be extended by a reverse transcriptase, e.g., during the first strand cDNA synthesis step.

Following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. The resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 1. The resultant population of sample-barcoded anchor-domain-flanked double-stranded gene-specific DNA fragments may be further processed, e.g., further amplified, e.g., to add sequencing adaptors, etc., such as described in greater detail below.

In a variation of the protocol illustrated in FIG. 1, the sample barcode domain that is ligated to GSPs is not initially present in a donor nucleic acid that includes a capture domain, such as a RNA binding domain, but instead in a sample barcode donor nucleic acid which lacks a capture, e.g., RNA, binding domain. In such instances the donor nucleic acid may still include an anchor domain positioned 5' of the sample barcode domain. In such instances, the sample barcode donor nucleic acid may be ligated to the GSPs at any convenient time, e.g., following hybridization of the GSPs to the template RNA, prior to GSP hybridization to template RNA, etc.

Figure 2:
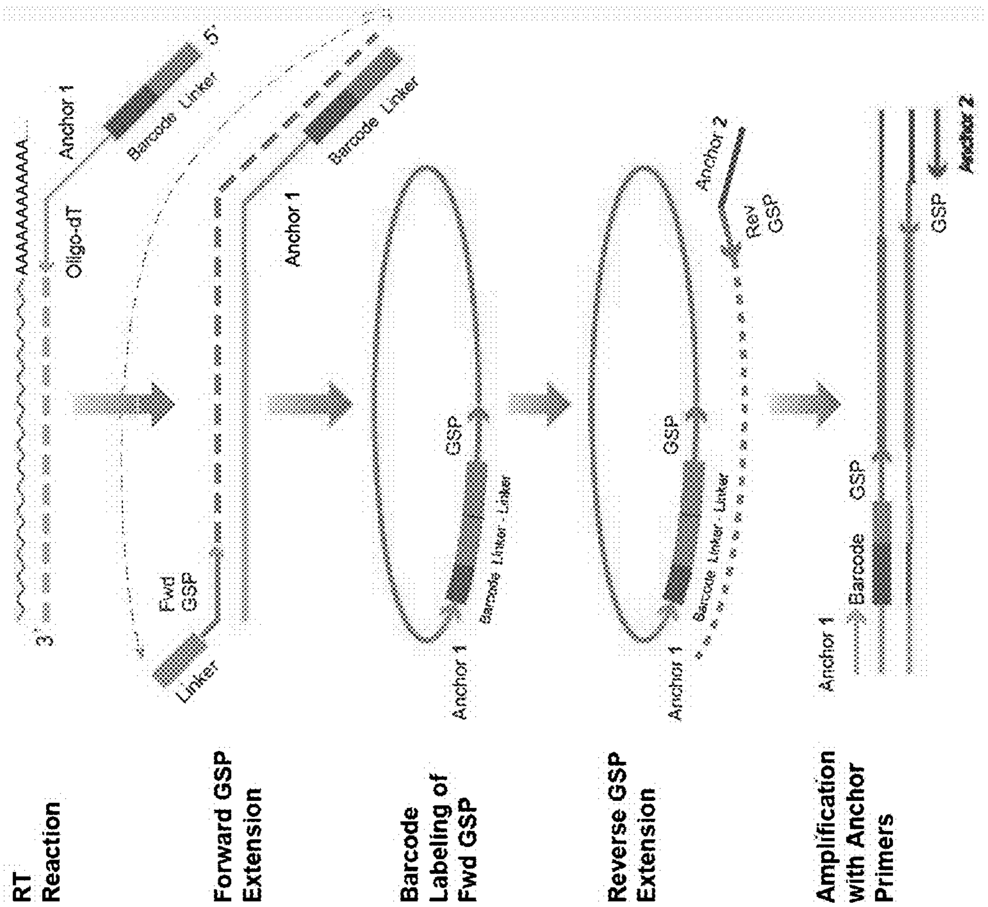
FIG. 2 provides a schematic diagram of a method of preparing a plurality of sample-barcoded anchor-domain-flanked gene specific DNA fragments in accordance with another embodiment of the invention.

In another embodiment where a donor nucleic acid is employed, a circular nucleic acid intermediate molecule is produced to transfer a sample barcode and anchor domain to a gene-specific primer. In examples of this embodiment, a forward GSP primed primer extension product, i.e., forward GSP primed second strand cDNA molecule, is circularized to transfer a sample barcode domain from an initial sample barcoded donor nucleic acid to the forward GSP, e.g., as illustrated in FIG. 2. As shown in the protocol illustrated in FIG. 2, the sample-barcoded donor nucleic acid comprises the structure: 3'-RNA binding domain-anchor 1 domain-sample barcode domain-linker 1 domain-5'. The RNA-binding domain may vary as desired, where examples of such domains include oligo dT domains, random sequence domains, and semi-random sequence domains which may be configured to interact and bind to conservative or common regions in RNA, e.g. polyA, short random sequences (e.g., N6) or short conservative sequences (e.g., nucleotide triplets coding the most abundant amino acids). The anchor 1, sample barcode and linker 1 domains may be as described above. Also, as described above, the donor nucleic acid may include a UMI domain, e.g., linked to the barcode domain, such as described above.

As illustrated in FIG. 2, the donor nucleic acid is employed to prime first strand cDNA synthesis, e.g., by contacting the RNA sample with the sample-barcoded donor nucleic acid under conditions sufficient to reverse transcribe first strand cDNA molecules from the RNA source, e.g., as reviewed in greater detail below. The resultant first strand cDNA molecules (i.e., donor nucleic acid primed primer extension products) are then contacted with a population of forward GSPs, where the forward GSPs include a linker domain and have the structure: 3'-forward GSP domain-linker 2-5'. Contact of the first strand cDNA molecule with the forward GSPs occurs under polymerase mediated primer extension reaction conditions sufficient to produce second strand cDNA molecules comprising a 5' linker 2 domain and a 3' linker 1 domain flanking a forward GSP primed domain, e.g., as illustrated in FIG. 2.

Following forward GSP mediated second strand cDNA synthesis, the flanking linker 1 and linker 2 domains are ligated to produce a circular intermediate, e.g., as illustrated in FIG. 2. To provide for sufficient proximity of the ends of the linker domains, a ligation linker may be employed. As reviewed above, the ligation linker is an oligonucleotide that includes a first domain complementary to the linker 1 domain of the RT primer and a second domain complementary to the linker 2 domain of the donor nucleic acid. When employed, the length of the ligated linker may vary, and in some instances ranges 15 to 60 nt, such as 20 to 50 nt, and including 24 to 40 nt. While not required, in some cases the ligation linker domain has a sequence with a GC-content in the range 50% to 80%. The linker 1 and linker 2 domains may be ligated to each other using any convenient DNA ligase, where DNA ligases that may be employed include, but are not limited to: DNA ligases, e.g., Ampligase® Thermostable DNA Ligase, CircLigase-DNA Ligase, *E. coli* DNA ligase, T3 DNA ligase, T4 DNA ligase, T7 DNA ligase, Taq DNA ligase, RNA ligase, and the like. As result of this ligation step and consequent circularization of the second strand cDNA molecule, the anchor and sample barcode domains from the initial donor nucleic acid are ligated 5' of the forward GSP. The resultant circularized second strand cDNA molecules are then contacted with the reverse GSPs under primer extension reaction conditions, e.g., as described in greater detail below. The reverse GSPs have the structure: 5'-anchor 2-reverse GSP domain-3' and contact under primer extension reaction conditions produces reverse GSP primed primer extensions products that include an anchor domain at their 5' ends. The resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 2. The resultant population of sample-barcoded anchor-domain-flanked double-stranded gene-specific DNA fragments may be further processed, e.g., further amplified, e.g., to add sequencing adaptors, etc., such as described in greater detail below.

Sample Barcoded GSP Mediated Protocols

As summarized above, embodiments of the methods employ gene specific primers that include a sample barcode domain. Specifically, in such embodiments at least one of the forward or reverse primers of the set of gene specific primers includes a sample barcode domain. In some instances, the reverse gene specific primers of the set, i.e., the reverse gene specific primer subset, include a sample barcode domain. In some instances, the forward gene specific primers of the set, i.e., the forward gene specific primer subset, include a sample barcode domain. Within the a given subset, while the gene specific domain will vary, the sample barcode domain is the same. In some instances, both the forward gene specific primers and the reverse gene specific primers include a barcode domain. In some instances, the barcode domain is 5' of the gene specific domain. In some instances where an anchor domain is also present, the anchor domain is 5' of the sample barcode domain. Other domains such as described above, e.g., UMI domain, etc., may also be present as desired. The length of the selected PCR primers may vary, in some embodiments the reverse barcoded primer is longer than forward primer. Reverse barcoded primer involving in stringent hybridization step with target RNA template composition could have the size in the range between 16 to 120 nt, such as 20 to 80 nt, including 25 to 60 nt, and 30 to 50 nt. Forward gene specific primers in some instances ranges from 16 to 25 nt, such as 18 to 24 nt.

The sample barcode containing gene specific primers employed in these embodiments may be prepared using any convenient protocol, including nucleic acid synthesis protocols, which protocols may or may not include a ligation step, e.g., as described in the working exemplification below. In some embodiments, the sample specific barcodes are attached to set of gene specific primers via a ligation reaction, such as mediated by DNA ligase activity. In ligation reactions, two oligonucleotides are ligated to each other using enzymes having ligation activity, such as DNA-ligases, Circligase, RNA-ligases, etc. The sample-specific barcodes may be ligated directly to the gene-specific primers using single-strand ligases, e.g., Circligase, RNA ligase, etc. In another embodiment, the sample barcodes may be ligated to the gene-specific primers via formation of double-stranded intermediate products and DNA ligases like T4 DNA ligase, Tth DNA ligase, Taq DNA ligase, etc., may be employed. The double-stranded intermediate products may be formed by using oligonucleotides complementary to the 5'-end of gene-specific primers and 3'-end of barcoded oligonucleotides. In order to simplify the ligation reaction composition, specific sequences may be provided at the both 5'-ends and 3'-ends of ligated molecules, e.g., linker domains disclosed in the current application. If both gene-specific primers and barcoded oligonucleotides have linker domains, adding oligonucleotide complementary to both linker domains will form double-stranded intermediates. These double-stranded intermediates with nick between two linker domains may then be ligated by DNA ligase. The linker domains of gene-specific primers may be phosphorylated. The labelling of gene-specific primers with sample-specific barcodes could be performed under gene-specific primer extension conditions, including adding reagents necessary for ligase activity, e.g. NAD, ATP, etc. In another embodiment, the barcode labeling conditions could be different from gene-specific primer extension conditions and use reaction buffer compositions specific for a particular DNA or RNA ligase. If all oligonucleotides are present in solution (e.g., in the wells of microtiter plates), the ligase-mediated barcoding reaction could be easily scaled-up for labeling sets of thousands of gene specific primers with hundreds of different unique sample-specific barcodes (in a separate wells).

Significantly larger scale (up to several millions) sample barcoded primers may be achieved if barcoded oligonucleotides are attached to the bead surface. Synthesis of barcoded oligonucleotides on the bead surface using combinatorial chemistry (pool and split synthesis approach) is well known in art technology and commonly applied for single-cell analysis. For the most single-cell RNA expression profiling assays developed so far, the oligonucleotides with structure: 5'-Anchor-Barcode-oligo dT-3' are synthesized on the beads, wherein the barcode is a combinatorial barcode unique for each bead and the oligo dT domain is a universal sequence used to prime cDNA synthesis from polyA tail of all mRNAs present in biological sample. The current invention uniquely allows the combination of known-in-art combinatorial bead-based barcode synthesis technology with DNA ligation assay for barcode labelling and immobilization of thousands of gene specific primers for each bead. The barcoded gene specific primers immobilized on the beads will be a unique experimental tool for high-throughput single-cell targeted expression profiling of hundreds-thousands of gene targets. As opposed to genome-wide barcode labeling of cDNAs using oligo dT-barcode strategy, the targeted labeling of subset of target transcripts address the main limitation (cost, throughput, quality of data) of current single-cell analysis technologies.

In another pool-split chemical synthesis embodiment, the thousands of gene-specific primers are synthesized on bead surface using conventional phosphoramidite chemistry in the 3'-to-5' direction. Furthermore, all bead-immobilized gene specific primers are mixed together and split for several (e.g., hundreds-thousands) compartments wherein each compartment comprises the same pool of gene specific primers. Each gene specific primer set immobilized on beads in each compartment is used in the next step of barcode synthesis wherein unique sample specific barcode will be synthesized in each compartment. As a result of this pool-split chemical synthesis strategy, the hundreds-thousands of sets of gene specific primers will be encoded with specific barcodes. The barcoded gene specific primer sets could be released from the beads and used in the disclosed primer extension assay.

Figure 3:
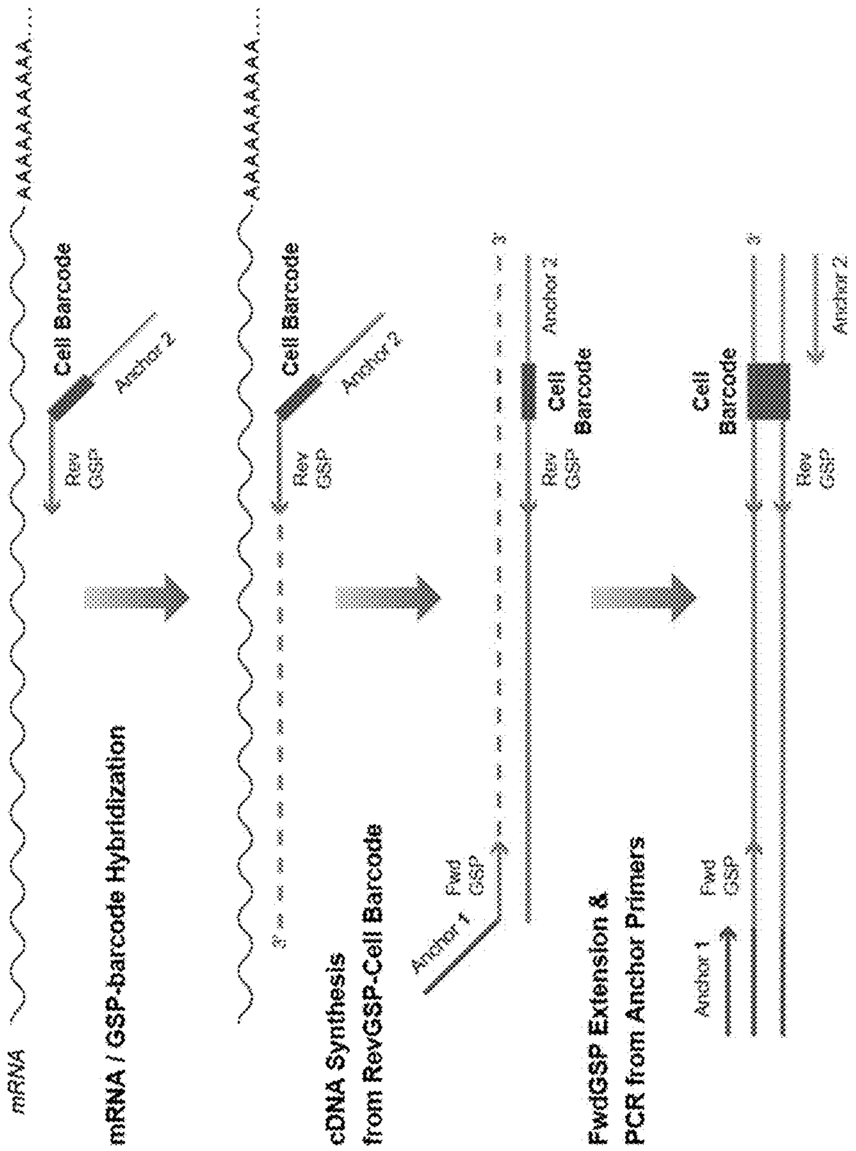
FIG. 3 provides a schematic diagram of a method of preparing a plurality of sample-barcoded anchor-domain-flanked gene specific DNA fragments using reverse primers that include a barcode domain in accordance with an embodiment of the invention.

A schematic illustration of an embodiment a protocol employed sample barcoded reverse gene specific primers is illustrated in FIG. 3. In the embodiment illustrated in FIG. 3, reverse gene specific primers are employed that include a 3' reverse gene specific primer domain (denoted RevGSP), a sample barcode domain (denoted as Cell Barcode) positioned 5' of the gene specific primer domain, and 5' anchor domain (denoted Anchor 2) that is 5' of the sample barcode domain. In the first step of the protocol illustrated in FIG. 3, the reverse gene specific primers are combined with the sample ribonucleic acids, e.g., an mRNA sample obtained from a single cell, under hybridization conditions such that the reverse gene specific primers bind to their complementary domains of the mRNAs. Where desired, the resultant mRNA template/GSP complexes of the resultant hybrid composition may be purified from any excess of unbound gene-specific primers, e.g., using any convenient protocol. For example, any excess of unbound oligonucleotides may be removed using purification protocols, such as but not limited to: nuclease treatment (e.g., exonuclease I treatment), chromatography, size-dependent binding to specific matrix, e.g. AMPure beads, etc.

In the embodiment illustrated in FIG. 3, following hybridization of the sample barcode domain anchor domain comprising reverse gene specific primers to mRNAs of the sample, the methods include reverse transcribing first strand cDNA molecules from the sample-barcoded reverse primers. Reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

As illustrated in FIG. 3, following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. Following any desired purification step, e.g., to remove unbound forward GSPs, the resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 3. The resultant population of sample-barcoded anchor-domain-flanked double-stranded gene-specific DNA fragments may be further processed, e.g., further amplified, e.g., to add sequencing adaptors, etc., such as described in greater detail below.

Figure 4:
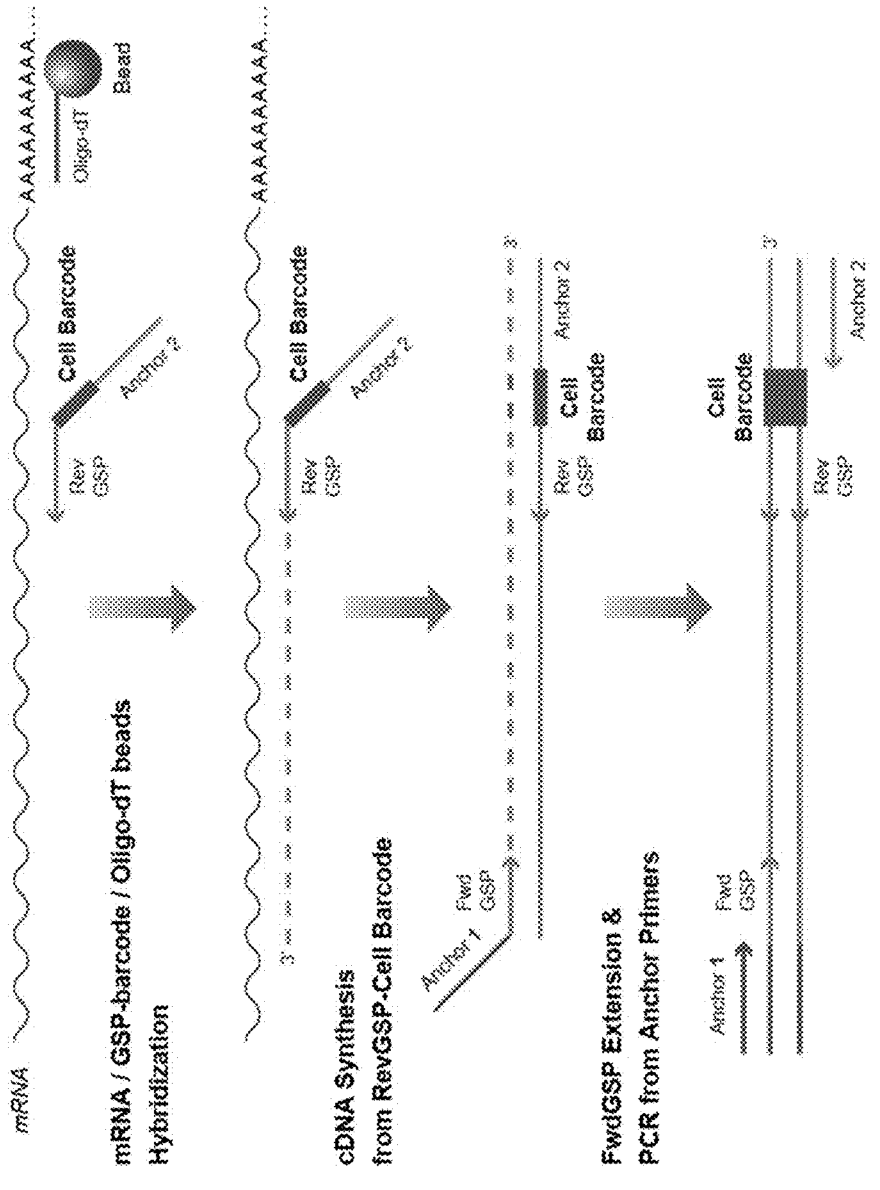
FIG. 4 provides a schematic diagram of a method of preparing a plurality of sample-barcoded anchor-domain-flanked gene specific DNA fragments using bead linked reverse primers that include a barcode domain in accordance with an embodiment of the invention.

In the embodiment illustrated in FIG. 4, reverse gene specific primers as employed in the protocol described for FIG. 3 are employed in conjunction with oligo-dT beads, such as described above. In the first step of the protocol illustrated in FIG. 4, the reverse gene specific primers and oligo-dT beads are combined with the sample ribonucleic acids, e.g., an mRNA sample obtained from a single cell, under hybridization conditions such that the reverse gene specific primers bind to their complementary domains of the mRNAs and the oligo-dT labels of the beads bind to the polyA tails of the mRNAs. Where desired, the resultant mRNA template/GSP/bead complexes of the resultant hybrid composition may be purified from any excess of unbound gene-specific primers, e.g., using any convenient protocol. In the illustrated embodiment shown in FIG. 4, the resultant complexes are immobilized on beads and can be purified from any excess of non-hybridized gene-specific primers using a convenient washing protocol, such as washing protocols known in the art.

In the embodiment illustrated in FIG. 4, following hybridization of the sample barcode domain anchor domain comprises reverse gene specific primers to mRNAs of the sample, the methods include reverse transcribing first strand cDNA molecules from the sample-barcoded reverse primers. Reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

As illustrated in FIG. 4, following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. The resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 4. The resultant population of sample-barcoded anchor-domain-flanked double-stranded gene-specific DNA fragments may be further processed, e.g., further amplified, e.g., to add sequencing adaptors, etc., such as described in greater detail below.

In some instances, the sample barcoded reverse primers are linked to a solid support. The solid support may vary, where examples of solid supports include beads, wells, plates, etc., e.g., made of a suitable solid phase material, such as a polymeric material, where the surface is configured to provide the desired bond to the reverse primers. In some instances, the reverse gene specific primer is linked to the solid support by a cleavable linker, i.e., a linker that may be broken in response to an applied stimulus. In such instances, any convenient cleavable linker may be employed. Examples of cleavable linkers that may be employed include, but are not limited to, thermal-labile linkers, enzymatically-labile linkers, light-labile linkers, etc.

In some instances, the linker is a thermal labile linker that includes a thermally-labile blocking moiety. A thermally-labile blocking moiety is a moiety that may be cleaved when the temperature of the primer is raised above a certain threshold value. While the threshold value may vary, in some instances the threshold value is 60° C. or higher, such as 75° C. or higher, including 90° C. or higher. Examples of thermally labile moieties that may be employed in accordance with the invention include, but are not limited to, those described in U.S. Pat. Nos. 8,133,669 and 8,361,753; the disclosures of which are herein incorporated by reference. In some instances, the thermally labile blocking moiety is a 3' blocking moiety, such as but not limited to: O-phenoxyacetyl; O-methoxyacetyl; O-acetyl; O-(p-toluene)sulfonate; O-phosphate; O-nitrate; O-[4-methoxy]-tetrahydrothiopyranyl; O-tetrahydrothiopyranyl; O-[5-methyl]-tetrahydrofuranyl; O-[2-methyl,4-methoxy]-tetrahydropyranyl; O-[5-methyl]-tetrahydropyranyl; and O-tetrahydrothiofuranyl.

In some instances, the linker is an enzymatically-labile linker. An enzymatically-labile linker includes a moiety that may be cleaved by exposing the linker to a suitable enzyme that cleaves the moiety. Examples of enzymatically-labile moieties of interest include those having a linkage group cleavable by a hydrolase enzyme. Examples of hydrolase enzymes of interest include, but are not limited to: esterases, phosphatases, peptidases, penicillin amidases, glycosidases and phosphorylases, kinases, etc. Hydrolase susceptible linkages and hydrolase enzymes are further described in U.S. Patent Application Publication No. 20050164182 and U.S. Pat. No. 7,078,499; the disclosures of which are herein incorporated by reference.

In some instances, the linker is a chemically-labile linker that includes a chemically-labile moiety. A chemically-labile is a moiety that may be cleaved by exposing the linker to a chemical agent that cleaves the moiety. The chemically-labile moiety may be reactive with the functional group of a chemical agent (e.g., an azido-containing modifiable group that is reactive with an alkynyl-containing reagent or a phosphine reagent, or vice versa, or a disulfide that is reactive with a reducing agent such as tris(2-carboxyethyl) phosphine (TCEP) or DTT). A variety of functional group chemistries and chemical agent stimuli suitable for modifying them may be utilized in the subject methods. Functional group chemistries and chemical agents of interest include, but are not limited to, click chemistry groups and reagents (e.g., as described by Sharpless et al., (2001), "Click Chemistry: Diverse Chemical Function from a Few Good Reactions", Angewandte Chemie International Edition 40 (11): 2004-2021), Staudinger ligation groups and reagents (e.g., as described by Bertozzi et al., (2000), "Cell Surface Engineering by a Modified Staudinger Reaction", Science 287 (5460): 2007), and other bioconjugation groups and reagents (e.g., as described by Hermanson, Bioconjugate Techniques, Second Edition, Academic Press, 2008). In certain embodiments, the chemically-labile blocking moiety includes a functional group selected from an azido, a phosphine (e.g., a triaryl phosphine or a trialkyl phosphine or mixtures thereof), a dithiol, an active ester, an alkynyl, a protected amino, a protected hydroxy, a protected thiol, a hydrazine, and a disulfide.

In some instances, the cleavable linker is a light-labile linker that includes a light-labile moiety, which is a moiety that may be cleaved by exposing the linker to light at a wavelength that cleaves the moiety from the linker. Examples of light-labile moieties of interest include cleavable by light of a certain wavelength that cleaves a photocleavable group in the linkage group. Any convenient photocleavable groups may find use. Cleavable groups and linkers may include photocleavable groups comprising covalent bonds that break upon exposure to light of a certain wavelength. Suitable photocleavable groups and linkers for use in the subject MCIPs include ortho-nitrobenzyl-based linkers, phenacyl linkers, alkoxybenzoin linkers, chromium arene complex linkers, NpSSMpact linkers and pivaloylglycol linkers, as described in Guillier et al. (Chem. Rev. 2000 1000:2091-2157). For example, a 1-(2-nitrophenyl)ethyl-based photocleavable linker (Ambergen) can be efficiently cleaved using near-UV light, e.g., achieving >90% yield in 5-10 minutes using a 365 nm peak lamp at 1-5 mW/cm2. In some embodiments, the modifiable group is a photocleavable group such as a nitro-aryl group, e.g., a nitro-indole group or a nitro-benzyl group, including but not limited to: 2-nitroveratryloxycarbonyl, α-carboxy-2-nitrobenzyl, 1-(2-nitrophenyl)ethyl, 1-(4,5-dimethoxy-2-nitrophenyl)ethyl and 5-carboxymethoxy-2-nitrobenzyl. Nitro-indole groups of interest include, e.g., a 3-nitro-indole, a 4-nitro indole, a 5-nitro indole, a 6-nitro-indole or a 7-nitro-indole group, where the indole ring may be further substituted at any suitable position, e.g., with a methyl group or a halo group (e.g., a bromo or chloro), e.g., at the 3-, 5- or 7-position. In certain embodiments, the nitro-aryl group is a 7-nitro indolyl group. In certain instances, the 7-nitro indolyl group is further substituted with a substituent that increases the photoactivity of the group, e.g., substituted with a bromo at the 5-position. Any convenient photochemistry of nitroaryl groups may be adapted for use. In certain embodiments, the linker includes a photocleavable group, such as a nitrobenzyl protecting group or a nitro-indolyl group.

Figure 5:
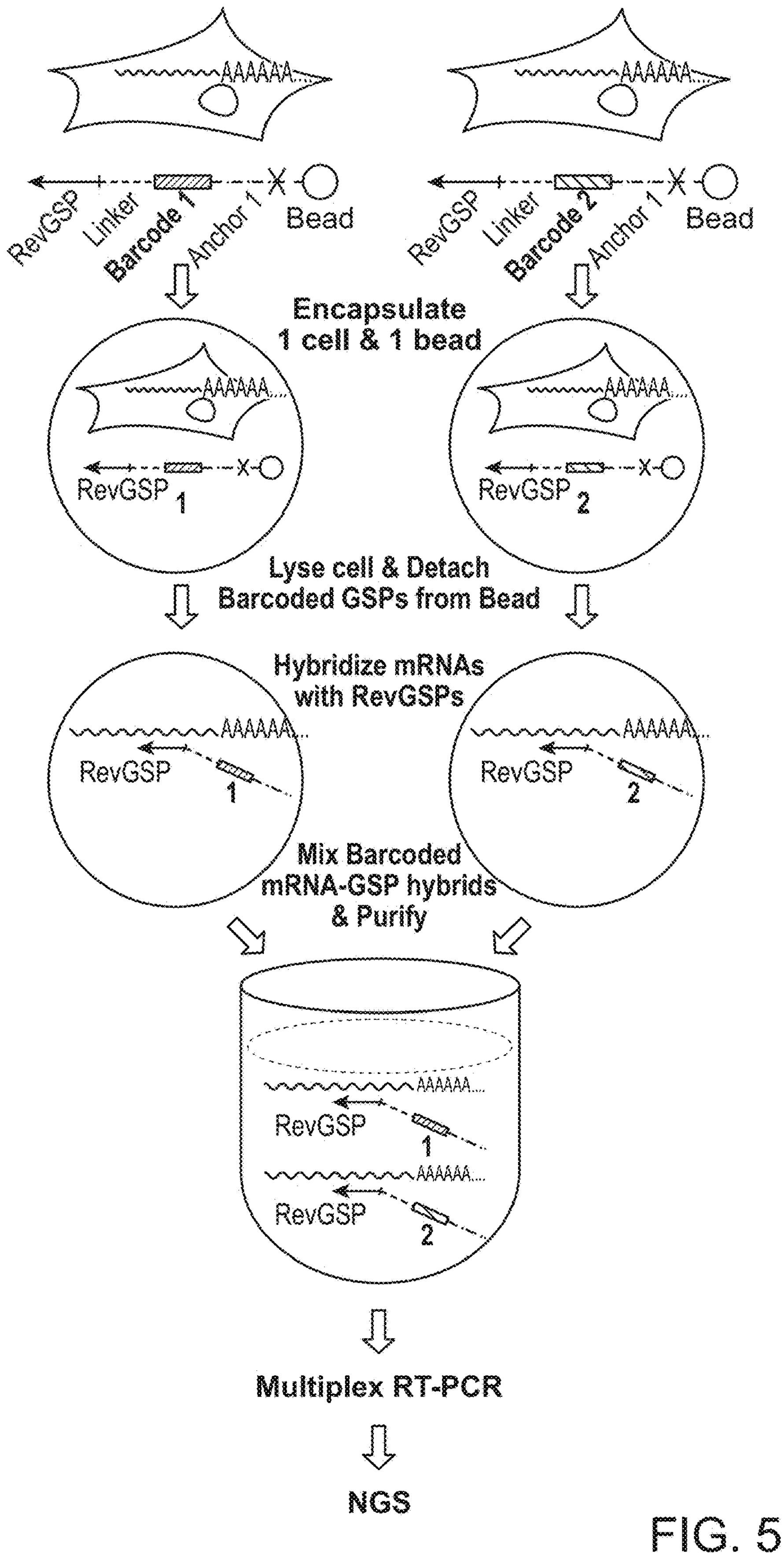
FIG. 5 provides a schematic diagram of a method of preparing a plurality of sample-barcoded anchor-domain-flanked gene specific DNA fragments using bead linked sample barcode domain comprising reverse primers in a droplet mediated protocol in accordance with an embodiment of the invention.

An example of a protocol that employs sample barcoded reverse gene specific primers linked to a solid support by a cleavable linker is illustrated in FIG. 5. In the protocol illustrated in FIG. 5, template ribonucleic acids from two cells are employed, where the protocol employs a pooling step and sample barcodes to match the results to the cellular source. As illustrated in FIG. 5, reverse gene specific primers are employed that include a 3' reverse gene specific primer domain (denoted RevGSP), a non-cleavable linker domain (denoted Linker) that is 5' of the RevGSP, a sample barcode domain (denoted as Barcode 1 or Barcode 2) positioned 5' of the non-cleavable linker, a 5' anchor domain (denoted Anchor 1) that is 5' of the sample barcode domain, and a bead linked to the 5' end of the Anchor 1 domain by a cleavable linker (shown as an X).

In the first step of the protocol illustrated in FIG. 5, the sample barcoded reverse gene specific primers that include the Barcode 1 sample barcode are combined with a first cell and encapsulated in a first droplet, e.g., as described below. The sample barcoded reverse gene specific primers that include the Barcode 2 sample barcode are combined with a second cell and encapsulated in a second droplet. The cells in the first and second droplets are then lysed and the beads are removed from the reverse primers by cleaving the cleavable linker. In each of the first and second droplets, the resultant cleaved reverse primers are maintained with the liberated mRNAs obtained from the lysed cells under hybridization conditions such that the reverse gene specific primers bind to their complementary domains of the mRNAs.

As illustrated in FIG. 5, the first and second droplets containing the resultant hybrid composition of the mRNA template/GSP complexes are then combined or pooled into a single composition. Following this pooling step, excess unbound gene-specific primers are removed from the combined composition so that the combined hybrid compositions can be purified from any excess of unbound gene-specific primers, e.g., using any convenient protocol. For example, any excess of unbound oligonucleotides may be removed using purification protocols, such as but not limited to: nuclease treatment (e.g., exonuclease I treatment), chromatography, size-dependent binding to specific matrix, e.g. AMPure beads, etc.

In the embodiment illustrated in FIG. 5, following purification, the methods include reverse transcribing first strand cDNA molecules from the sample-barcoded reverse primers. As reviewed above, reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

Following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. Following any desired purification, e.g., to remove unbound forward GSPs, the resultant primer extension products may then be amplified, e.g., using universal primers that bind to the anchor domains, which results in production of a plurality of sample-barcoded anchor-domain-flanked double-stranded gene specific DNA fragments. The resultant population of sample-barcoded anchor-domain-flanked double-stranded gene-specific DNA fragments may be further processed, e.g., further amplified, e.g., to add sequencing adaptors, etc., such as described in greater detail below, e.g., for performing NGS.

In some instances where the sample barcoded reverse primers are bound to a solid support, such as a bead, by a cleavable linker (e.g., as described above), the solid support may further include a specific binding pair member, e.g., that includes a specific binding domain that specifically binds to a marker of a cell of interest. Specific binding domains of interest include, but are not limited to, antibody binding agents, proteins, peptides, haptens, nucleic acids, etc. The term “antibody binding agent” as used herein includes polyclonal or monoclonal antibodies or fragments that are sufficient to bind to an analyte of interest. The antibody fragments can be, for example, monomeric Fab fragments, monomeric Fab' fragments, or dimeric F(ab)'2 fragments. Also within the scope of the term “antibody binding agent” are molecules produced by antibody engineering, such as single-chain antibody molecules (scFv) or humanized or chimeric antibodies produced from monoclonal antibodies by replacement of the constant regions of the heavy and light chains to produce chimeric antibodies or replacement of both the constant regions and the framework portions of the variable regions to produce humanized antibodies. The marker of the cell of interest may be any convenient marker, such as a cell surface protein or structure having an epitope to which the specific binding domain may specifically bind. In such instances, the bead linked sample barcoded reverse primers may include one or more additional domains of interest, such as bead identifying domains (bead barcodes), antibody identifying domains (antibody barcodes), etc.

Figure 6:
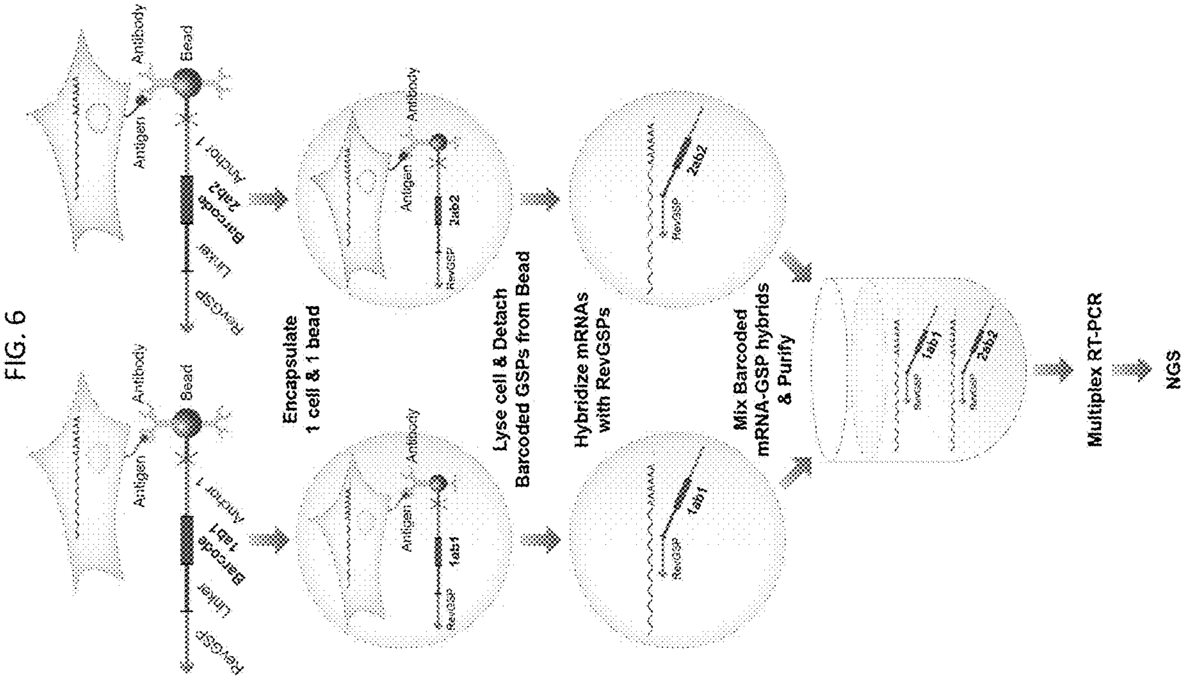
FIG. 6 provides a schematic diagram of a method of preparing a plurality of sample-barcoded anchor-domain-flanked gene specific deoxyribonucleic acid (DNA) fragments using specific binding member bead linked sample barcode domain comprising reverse primers in a droplet mediated protocol in accordance with an embodiment of the invention.

An example of a protocol that employs sample barcoded reverse gene specific primers linked to a solid support by a cleavable linker, where the support includes a cell specific binding domain, is illustrated in FIG. 6. In the protocol illustrated in FIG. 6, template ribonucleic acids from two cells are employed, where the protocol employs a pooling step and sample barcodes are employed to match the results to the cellular source and antibody employed. As illustrated in FIG. 6, reverse gene specific primers are employed that include a 3' reverse gene specific primer domain (denoted RevGSP), a non-cleavable linker domain (denoted Linker) that is 5' of the RevGSP, a sample barcode domain (denoted as Barcode 1 or Barcode 2) positioned 5' of the non-cleavable linker, an antibody barcode domain (denoted ab1 or ab2) positioned 5' of the sample barcode domain, a 5' anchor domain (denoted Anchor 1) that is 5' of the sample barcode domain, a bead linked to the 5' end of the Anchor 1 domain by a cleavable linker (shown as an X) and an antibody on the bead that specifically binds to a cell surface antigen.

In the first step of the protocol illustrated in FIG. 6, the sample barcoded reverse gene specific primers that include the Barcode 1 sample barcode and ab1 barcode (collectively denoted 1ab1) are combined with a first cell under conditions sufficient for the antibody on the bead to specifically bind to the antigen on the cell, and the resultant binding complex is encapsulated in a first droplet. The sample barcoded reverse gene specific primers that include the Barcode 2 sample barcode and ab2 barcode (collectively denoted 2ab2) are combined with a second cell under conditions sufficient for the antibody on the bead to specifically bind to the antigen on the cell, and the resultant binding complex is encapsulated in a second droplet. The cells in the first and second droplets are then lysed and the beads are removed from the reverse primers by cleaving the cleavable linker. In each of the first and second droplets, the resultant cleaved reverse primers are maintained with the liberated mRNAs obtained from the lysed cells under hybridization conditions such that the reverse gene specific primers bind to their complementary domains of the mRNAs.

As illustrated in FIG. 6, the first and second droplets containing the resultant hybrid composition of the mRNA template/GSP complexes are then combined or pooled into a single composition. Following this pooling step, excess unbound gene-specific primers are removed from the combined composition so that the combined hybrid compositions can be purified from any excess of unbound gene-specific primers, e.g., using any convenient protocol. For example, any excess of unbound oligonucleotides may be removed using purification protocols, such as but not limited to: nuclease treatment (e.g., exonuclease I treatment), chromatography, size-dependent binding to specific matrix, e.g. AMPure beads, etc.

In the embodiment illustrated in FIG. 6, following purification, the methods include reverse transcribing first strand cDNA molecules from the sample-barcoded reverse primers. As reviewed above, reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

Following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. Following any desired purification, e.g., to remove unbound forward GSPs, the resultant primer extension products may then be amplified, e.g., using universal primers that bind to the anchor domains, which results in production of a plurality of sample-barcoded anchor-domain-flanked double-stranded gene specific DNA fragments. The resultant population of sample-barcoded anchor-domain-flanked double-stranded gene-specific DNA fragments may be further processed, e.g., further amplified, e.g., to add sequencing adaptors, etc., such as described in greater detail below, e.g., for performing NGS.

Template Nucleic Acids

Components of the subject reaction mixtures may include one or more template nucleic acids. Such template nucleic acids provide the template from which template nucleic acid-mediated primer extension reactions and other nucleic acid production reactions may be performed. Nucleic acid templates may be added to a reaction mixture, e.g., through direct addition of the nucleic acid template, through lysing one or more cells containing the nucleic acid template, and the like, or one or more nucleic acid templates may be generated during the reaction, e.g., as an intermediate product of a prior nucleic acid production reaction. Essentially any nucleic acid template may find use in the subject methods, including e.g., RNA template nucleic acid and DNA template nucleic acids. RNA template nucleic acids may vary and may include e.g., messenger RNA (mRNA) templates, and the like. In addition, various types of DNA templates may be employed, including but not limited to e.g., genomic DNA templates, mtDNA templates, synthetic DNA templates, etc.

According to certain embodiments, the template nucleic acids are template ribonucleic acids (template RNA). Template RNAs may be any type of RNA (or sub-type thereof) including, but not limited to, a messenger RNA (mRNA), a microRNA (miRNA), a small interfering RNA (siRNA), a transacting small interfering RNA (ta-siRNA), a natural small interfering RNA (nat-siRNA), a ribosomal RNA (rRNA), a transfer RNA (tRNA), a small nucleolar RNA (snoRNA), a small nuclear RNA (snRNA), a long non-coding RNA (lncRNA), a non-coding RNA (ncRNA), a transfer-messenger RNA (tmRNA), a precursor messenger RNA (pre-mRNA), a small Cajal body-specific RNA (scaRNA), a piwi-interacting RNA (piRNA), an endoribonuclease-prepared siRNA (esiRNA), a small temporal RNA (stRNA), a signal recognition RNA, a telomere RNA, a ribozyme, or any combination of RNA types thereof or subtypes thereof.

According to certain embodiments, the template nucleic acids are template deoxyribonucleic acids (template DNA). A template DNA may be any type of DNA of interest to a practitioner of the subject methods, including but not limited to genomic DNA or fragments thereof, complementary DNA (or "cDNA", synthesized from any RNA or DNA of interest), recombinant DNA (e.g., plasmid DNA), or the like.

The number of distinct template nucleic acids of differing sequence in a given template nucleic acid composition may vary. While the number of distinct template nucleic acids in a given template nucleic acid composition may vary, in some instances the number of distinct template nucleic acids in a given template nucleic acid composition ranges from 1 to $10^6$, such as 1 to $10^7$, including 1 to $10^5$.

The template nucleic acid composition employed in such methods may be any suitable nucleic acid sample. The nucleic acid sample that includes the template nucleic acid may be combined into the reaction mixture in an amount sufficient for producing the product nucleic acid. According to one embodiment, the nucleic acid sample is combined into the reaction mixture such that the final concentration of nucleic acid in the reaction mixture is from 1 fg/μL to 10 μg/μL, such as from 1 μg/μL to 5 μg/μL, such as from 0.001 μg/μL to 2.5 μg/μL, such as from 0.005 μg/μL to 1 μg/μL, such as from 0.01 μg/μL to 0.5 μg/μL, including from 0.1 μg/μL to 0.25 μg/μL.

Template nucleic acid components are nucleic acid samples that contain one or more types of template nucleic acids, as described in more detail below. Template nucleic acid components may be derived from cellular samples including cellular samples that contain a single cell or a population of cells containing, e.g., two or more cells. Cellular samples may be derived from a variety of sources including but not limited to e.g., a cellular tissue, a biopsy, a blood sample, a cell culture, etc. Additionally, cellular samples may be derived from specific organs, tissues, tumors, neoplasms, or the like. Furthermore, cells from any population can be the source of a cellular sample used in the subject methods, such as a population of prokaryotic or eukaryotic single celled organisms including bacteria or yeast.

As such, in some instances, the source of an RNA sample utilized in the subject methods may be a mammalian cellular sample, such as a rodent (e.g., mouse or rat) cellular sample, a non-human primate cellular sample, a human cellular sample, or the like. In some instances, a mammalian cellular sample may be mammalian blood sample, including but not limited to e.g., a rodent (e.g., mouse or rat) blood sample, a non-human primate blood sample, a human blood sample, or the like.

In some instances, the template nucleic acid component is from a single cell. A template nucleic acid component from a single cell is a nucleic acid composition, e.g., a composition of one or more distinct nucleic acids, such as ribonucleic acids or deoxyribonucleic acids that originate or are derived from a single cell. As used herein, a "single cell" refers to one cell. Single cells useful as the source of template nucleic acids, e.g., RNAs or DNAs, can be obtained from an organism or tissue of interest, or from a biopsy, blood sample, or cell culture, etc. Additionally, cells from specific organs, tissues, tumors, neoplasms, or the like can be obtained and used in the methods described herein. In some instances, the template nucleic acid component is obtained from a portion of a single cell. Single cell portions of interest include, but are not limited to: organelles, exosomes or more broadly nucleic acids contained within, or associated with, a protein and or lipid bearing membrane.

Template nucleic acids of template nucleic acid components employed in embodiments of the invention may contain a plurality of distinct template nucleic acids of differing sequence. Template nucleic acids (e.g., a template RNA, a template DNA, or the like) may be polymers of any length. While the length of the polymers may vary, in some instances the polymers are 10 nt or longer, 20 nt or longer, 50 nt or longer, 100 nt or longer, 500 nt or longer, 1000 nt or longer, 2000 nt or longer, 3000 nt or longer, 4000 nt or longer, 5000 nt or longer or more nt. In certain aspects, template nucleic acids are polymers, where the number of bases on a polymer may vary, and in some instances is 10 nt or less, 20 nt or less, 50 nt or less, 100 nt or less, 500 nt or less, 1000 nt or less, 2000 nt or less, 3000 nt or less, 4000 nt or less, or 5000 nt or less, 10,000 nt or less, 25,000 nt or less, 50,000 nt or less, 75,000 nt or less, 100,000 nt or less.

Single cells, for use in the herein described methods relating thereto, may be obtained by any convenient method. For example, in some instances, single cells may be obtained through limiting dilution of cellular sample. In some instances, the present methods may include a step of obtaining single cells. A single cell suspension can be obtained using standard methods known in the art including, for example, enzymatically using trypsin or papain to digest proteins connecting cells in tissue samples or releasing adherent cells in culture, or mechanically separating cells in a sample. Single cells can be placed in any suitable reaction vessel in which single cells can be treated individually. For example, a 96-well plate, 384 well plate, or a plate with any number of wells such as 2000, 4000, 6000, or 10000 or more. The multi-well plate can be part of a chip and/or device. The present disclosure is not limited by the number of wells in the multi-well plate. In various embodiments, the total number of wells on the plate is from 100 to 200,000, or from 5000 to 10,000. In other embodiments the plate comprises smaller chips, each of which includes 5,000 to 20,000 wells. For example, a square chip may include 125 by 125 nanowells, with a diameter of 0.1 mm. Such methods are further described in greater detail below.

In some instances, single cells may be obtained by sorting a cellular sample using a cell sorter instrument. By "cell sorter" as used herein is meant any instrument that allows for the sorting of individual cells into an appropriate vessel for downstream processes, such as those processes of library preparation as described herein. Useful cell sorters include flow cytometers, such as those instruments utilized in fluorescence activated cell sorting (FACS). Flow cytometry is a well-known methodology using multi-parameter data for identifying and distinguishing between different particle (e.g., cell) types i.e., particles that vary from one another terms of label (wavelength, intensity), size, etc., in a fluid medium. In flow cytometrically analyzing a sample, an aliquot of the sample is first introduced into the flow path of the flow cytometer. When in the flow path, the cells in the sample are passed substantially one at a time through one or more sensing regions, where each of the cells is exposed separately individually to a source of light at a single wavelength (or in some instances two or more distinct sources of light) and measurements of scatter and/or fluorescent parameters, as desired, are separately recorded for each cell. The data recorded for each cell is analyzed in real time or stored in a data storage and analysis means, such as a computer, for later analysis, as desired.

Cells sorted using a flow cytometer may be sorted into a common vessel (i.e., a single tube), or may be separately sorted into individual vessels. For example, in some instances, cells may be sorted into individual wells of a multi-well plate, as described below.

Useful cell sorters also include multi-well-based systems that do not employ flow cytometry. Such multi-well based systems include essentially any system where cells may be deposited into individual wells of a multi-well container by any convenient means, including e.g., through the use of Poisson distribution (i.e., limiting dilution) statistics, individual placement of cells (e.g., through manual cell picking or dispensing using a robotic arm or pipettor). In some instances, useful multi-well systems include a multi-well wafer or chip, where cells are deposited into the wells or the wafer/chip and individually identified by a microscopic analysis system. In some instances, an automated microscopic analysis system may be employed in conjunction with a multi-well wafer/chip to automatically identify individual cells to be subjected to downstream analyses, including library preparation, as described herein.

In some instances, one or more cells may be sorted into or otherwise transferred to an appropriate reaction vessel. Reaction components may be added to reaction vessels, including e.g., components for preparing a template nucleic acid component, components for generating a product double stranded cDNA, components for one or more library preparation reactions, etc.

The wells of a multi-well device can be designed such that a single well includes a single cell or a single droplet. An individual cell or droplet may also be isolated in any other suitable container, e.g., microfluidic chamber, droplet, nanowell, tube, etc. Any convenient method for manipulating single cells or droplets may be employed, where such methods include fluorescence activated cell sorting (FACS), robotic device injection, gravity flow, or micromanipulation and the use of semi-automated cell pickers (e.g. the Quixell™ cell transfer system from Stoelting Co.), etc. In some instances, single cells or droplets can be deposited in wells of a plate according to Poisson statistics (e.g., such that approximately 10%, 20%, 30% or 40% or more of the wells contain a single cell or droplet—which number can be defined by adjusting the number of cells or droplets in a given unit volume of fluid that is to be dispensed into the containers). In some instances, a suitable reaction vessel comprises a droplet (e.g., a microdroplet). Individual cells or droplets can, for example, be individually selected based on features detectable by microscopic observation, such as location, morphology, the presence of a reporter gene (e.g., expression), the presence of a bound antibody (e.g., antibody labelling), FISH, the presence of an RNA (e.g., intracellular RNA labelling), or qPCR.

Following obtainment of a desired cell population or single cells, e.g., as described above, nucleic acids can be released from the cells by lysing the cells. Lysis can be achieved by, for example, heating or freeze-thaw of the cells, or by the use of detergents or other chemical methods, or by a combination of these. However, any suitable lysis method can be used. In some instances, a mild lysis procedure can advantageously be used to prevent the release of nuclear chromatin, thereby avoiding genomic contamination of a cDNA library, and to minimize degradation of mRNA. For example, heating the cells at 72° C. for 2 minutes in the presence of Tween-20 is sufficient to lyse the cells while resulting in no detectable genomic contamination from nuclear chromatin. Alternatively, cells can be heated to 65° C. for 10 minutes in water (Esumi et al., Neurosci Res 60(4):439-51 (2008)); or 70° C. for 90 seconds in PCR buffer II (Applied Biosystems) supplemented with 0.5% NP-40 (Kuimoto et al., Nucleic Acids Res 34(5):e42 (2006)); or lysis can be achieved with a protease such as Proteinase K or by the use of chaotropic salts such as guanidine isothiocyanate (U.S. Publication No. 2007/0281313).

Calibration Control Template Composition

In some instances, preparation of the target nucleic acid template composition includes combining an initial nucleic acid composition, e.g., as described above, with a calibration control template composition, e.g., to produce a target nucleic acid template composition that is spiked with a control template mixture, which mixture may be made up of synthetic nucleic acids, naturally occurring nucleic acids or a combination thereof. As to structural requirements, the calibration control template nucleic acids at least include an amplicon structure with two primer binding sites which mimic natural target template nucleic acid. In some embodiments, the control template mix is a synthetic control template mix that includes calibration control template nucleic acids having sequences that mimic, but are different from, the sequences of target template nucleic acids. For example, a calibration control template nucleic acid could have one, two, or more point mutations downstream of primer binding sites. These mutations may be identified by downstream NGS analysis allowing one to uniquely identify and differentiate sample specific and control template nucleic acids from each other. Other types of control template modifications (e.g., deletions, insertions, etc.) could be employed, as desired. Furthermore, the calibration control templates may mimic natural target nucleic acid template structures. For example, synthetic gene or gene fragments with several point mutations could be synthesized under the control of a T7 promoter, and T7 transcripts which mimic the natural template target mRNA sequences and structures could be synthesized in vitro and spiked to into a cell extract or purified RNA at any known concentration. Moreover, the set of calibration standards designed against the same target mRNA with different mutations could be spiked into target template compositions at different amounts (e.g. at 1, 10, 100, 1000 copies per cell). The spiked calibration controls could be employed as internal calibration standards in primer extension assays which allow one to calculate the actual concentration of natural target mRNA template. Moreover, the spiked calibration standards may be employed as universal standards to do quality control of target mRNAs in biological samples. For example, if cells are apoptotic, non-functional or damaged, the calibration standards spiked into a single-cell analysis would allow one to reveal these defect cells with degraded or missing template RNAs. The calibration control nucleic acid templates could be spiked directly into a cell, cell extract, cell fractions, purified cells or at any step of the primer extension and multiplex PCR protocol. In one embodiment, the control nucleic acid templates are spiked into cells, cell extracts or purified RNA. For example, in single-cell analysis, the control RNA templates could be mixed with lysis/hybridization buffer prior to droplet formation in 10×Genomics, Mission Bio or BioRad single-cell analysis platforms. In other embodiments, the control template compositions could be spiked into cell lysates by pipet (e.g., ink-jet printer) or immobilized on beads together with barcoded gene specific primers. Calibration control templates could be designed and developed for single gene or gene sets including genome-wide set. For example, a mix of calibration control RNAs could be developed for a set of housekeeping genes. The housekeeping calibration control RNAs would allow one to compare the content and quality of target template RNAs in the single-cells or multiplex analysis of plurality of clinical samples. The set of cell specific marker calibration control RNAs may allow one to perform QC and identify specific cell types. Genome-wide set of calibration control RNAs could be employed to perform quantitative analysis of expression of all genes in any cell or biological sample. In another embodiment, the calibration control RNAs designed against pathogens (e.g. viruses, bacterial species, etc.) may be employed as a unique tool to perform quantitative expression analysis of pathogenic genes in the background of human transcripts in clinical samples. Calibration control templates as internal calibration standards are unique tool for analysis plurality of biological samples in parallel. Combination of barcoded gene specific primers and calibration control nucleic acid templates allows one to combine samples together at the early stage of the protocol and perform powerful multiplex analysis of hundreds of samples or thousands of single cells in parallel in single test tube.

Primer Extension Reaction Conditions

As reviewed above, aspects of the methods include contacting primers, e.g., oligo dT primers and/or GSPs, such as described above, with a nucleic acid template composition, which may be made up of an initial nucleic acid sample or be primer extension products, under primer extension reaction conditions. By "primer extension reaction conditions" is meant reaction conditions that permit polymerase-mediated extension of a 3' end of a nucleic acid strand, i.e., primer, hybridized to a template nucleic acid. Achieving suitable reaction conditions may include selecting reaction mixture components, concentrations thereof, and a reaction temperature to create an environment in which the polymerase is active and the relevant nucleic acids in the reaction interact (e.g., hybridize) with one another in the desired manner.

The concentration of primers in the primer extension reaction mixture produced upon combination of the template nucleic acid and primers may vary, as desired. The amount of target template nucleic acid that is combined with the primers and other reagents, e.g., as described below, to produce a primer extension reaction mixture may vary. In some instances, the target nucleic acid template composition is combined into the reaction mixture such that the final concentration of nucleic acid in the reaction mixture ranges from 1 fg/μL to 10 μg/μL, such as from 1 μg/μL to 5 μg/μL, such as from 0.1 ng/μL to 50 ng/μL, such as from 0.5 ng/μL to 20 ng/μL, including from 1 ng/μL to 10 ng/μL.

In producing the primer extension reaction mixture, the primers and target template nucleic acid composition are combined with a number of additional reagents (e.g., to increase specificity, uniformity, yield, etc. of extension products), which may vary as desired. A variety of polymerases may be employed when practicing the subject methods. Reference to a particular polymerase, such as those exemplified below, will be understood to include functional variants thereof unless indicated otherwise. Examples of useful polymerases include DNA polymerases, e.g., where the template nucleic acid is DNA. In some instances, DNA polymerases of interest include, but are not limited to: thermostable DNA polymerases, such as may be obtained from a variety of bacterial species, including *Thermus aquaticus* (Taq), *Thermus thermophilus* (Tth), *Thermus filiformis, Thermus flavus, Thermococcus literalis*, and *Pyrococcus furiosus* (Pfu) or modified and mutated versions of these DNA polymerases (e.g. Phusion DNA polymerase, Q5 DNA polymerase, etc.). Alternatively, where the target template nucleic acid composition is made up of RNA, the polymerase may be a reverse transcriptase (RT), where examples of reverse transcriptases include Moloney Murine Leukemia Virus reverse transcriptase (MMLV RT), e.g., SuprScript II, SuperScript III, MaxiScript reverse transcriptase (Thermo-Fsher), SMARTScribe™ reverse transcriptase (Takara), AMV reverse transcriptase, *Bombyx mori* reverse transcriptase (e.g., *Bombyx mori* R2 non-LTR element reverse transcriptase), etc. In one embodiment, the enzymes with DNA polymerase activity are designed for hot-start primer extension reaction, e.g., used as a complex with specific antibody or chemical compound which blocks enzymatic activity at low temperature but fully releases the activity at reaction conditions. For example, in some instances a hot-start reverse transcriptase composition, e.g. complex between MMLV RT and Therma-Stop RT reagent (Thermagenix) is employed.

Primer extension reaction mixtures also include dNTPs. In certain aspects, each of the four naturally-occurring dNTPs (dATP, dGTP, dCTP and dTTP) are added to the reaction mixture. For example, dATP, dGTP, dCTP and dTTP may be added to the reaction mixture such that the final concentration of each dNTP is from 0.05 to 10 mM, such as from 0.1 to 2 mM, including 0.2 to 1 mM. According to one embodiment, at least one type of nucleotide added to the reaction mixture is a non-naturally occurring nucleotide, e.g., a modified nucleotide having a binding or other moiety (e.g., a fluorescent moiety) attached thereto, a nucleotide analog, or any other type of non-naturally occurring nucleotide that finds use in the subject methods or a downstream application of interest.

In addition to the template nucleic acid, primers, the polymerase, and dNTPs, the reaction mixture may include buffer components that establish an appropriate pH, salt concentration (e.g., KCl concentration), metal cofactor concentration (e.g., $Mg^{2+}$ or $Mn^{2+}$ concentration), and the like, for the extension reaction and template switching to occur. Other components may be included, such as one or more nuclease inhibitors (e.g., an RNase inhibitor and/or a DNase inhibitor), one or more additives for facilitating amplification/replication of GC rich sequences (e.g., GC-Melt™ reagent (Clontech Laboratories, Inc. (Mountain View, CA)), betaine, single-stranded binding proteins (e.g., T4 Gene 32, cold shock protein A (CspA), recA protein, and/or the like) DMSO, ethylene glycol, 1,2-propanediol, or combinations thereof), one or more molecular crowding agents (e.g., polyethylene glycol, or the like), one or more enzyme-stabilizing components (e.g., DTT present at a final concentration ranging from 1 to 10 mM (e.g., 5 mM)), and/or any other reaction mixture components useful for facilitating polymerase-mediated extension reactions.

The primer extension reaction mixture can have a pH suitable for the primer extension reaction. In certain embodiments, the pH of the reaction mixture ranges from 5 to 9, such as from 7 to 9, including from 8 to 9, e.g., 8 to 8.5. In some instances, the reaction mixture includes a pH adjusting agent. pH adjusting agents of interest include, but are not limited to, sodium hydroxide, hydrochloric acid, phosphoric acid buffer solution, citric acid buffer solution, and the like. For example, the pH of the reaction mixture can be adjusted to the desired range by adding an appropriate amount of the pH adjusting agent.

The temperature range suitable for production of the product nucleic acid may vary according to factors such as the particular polymerase employed, the melting temperatures of any optional primers employed, etc. According to one embodiment, the primer extension reaction conditions include bringing the reaction mixture to a temperature ranging from 4 to 72° C., such as from 16 to 70° C., e.g., 37 to 65° C., such as 60° C. to 65° C. The temperature of the reaction mixture may be maintained for a sufficient period of time for polymerase mediated, template directed primer extension to occur. While the period of time may vary, in some instances the period of time ranges from 5 to 60 minutes, such as 15 to 45 minutes, e.g., 30 minutes.

In a given primer extension reaction condition, where desired, hybridization complexes of template and primer may be purified, e.g., via separation from excess of non-bound primers, e.g., by nuclease treatment or binding to solid support, e.g., such as beads, e.g., as described above. In this way, excess of primers, such as oligo dT primers and/or gene-specific primers, may be removed in order to achieve a high specificity of primer extension reaction from the target template sequences.

As reviewed above, the barcode labelling step, i.e., where a barcode domain is transferred from an initial donor nucleic acid to a gene-specific primer, may be performed before, after or at the same time as a primer extension step. Transfer is mediated by a ligation reaction, where in some instances linker domains and a linker oligonucleotide are employed to enhance ligation results. Where ligation occurs at the same time as primer extension, primer extension conditions as described may be employed, where reagents necessary for ligase activity, e.g. NAD, ATP, etc., are included. Alternatively, ligation may be carried out in a step separate from primer extension.

Where desired, the primer extension reaction conditions may include one or more temperature cycling steps. For example, in some instances, the primer extension product composition is produced by a method that includes first contacting the target nucleic acid template composition with a first primer subset that includes for example the forward primers of the set of primer pairs under primer extension reaction conditions to produce a forward primer extension product composition; increasing the temperature to denature the resultant product and template strands and inactivate any additional enzymatic activity (e.g., exonuclease I activity added after extension step to degrade PCR primers) present in the forward primer extension product composition (where the elevated temperature may vary, ranging in some instances from 90 to 100° C., such as 95° C.) and then contacting the resultant denatured forward primer extension product composition with a second primer subset that includes the reverse primers of the set of primer pairs under primer extension reaction conditions to produce the desired primer extension product composition. Where desired, the primer extension products and template nucleic acids may be separated from any free forward primers prior to contact with the set of reverse primers. The extended DNA products after the first and second extension steps may be purified from the excess of the primers using any convenient protocol, including primer digestion with exonucleases (exonuclease I) or purification, such as Magnetic beads or spin columns, etc.

Amplification

As reviewed above, in some instances primer extension products are amplified, where amplicons are produced from the primer extension products. The term "amplicon" is employed in its conventional sense to refer to a piece of DNA that is the product of artificial amplification or replication events, e.g., as produced using various methods including polymerase chain reactions (PCR), ligase chain reactions (LCR), etc. Where primer extension products are amplified, the primer extension products, e.g., as described above, may include additional domains that are employed in subsequent amplification steps to produce a desired amplicon composition. For example, as illustrated in FIGS. 1 to 4, flanking anchor domains are provided in the primer extension products, where the flanking anchor domains include universal priming sites which may be employed in PCR amplification.

As such, embodiments of the methods may include combining a primer extension product composition with universal forward and reverse primers under amplification conditions sufficient to produce a desired product barcoded amplicon composition. The forward and reverse universal primers may be configured to bind to the common forward and reverse anchor domains and thereby nucleic acids present in the primer extension product compositions. The universal forward and reverse primers may vary in length, ranging in some instances from 10 to 75 nt, such as 15 to 60 nt.

In some instances, the universal forward and reverse primers include one or more additional domains, such as but not limited to: an indexing domain, a clustering domain, a Next Generation Sequencing (NGS) adaptor domain (i.e., high-throughput sequencing (HTS) adaptor domain), etc. Alternatively, these domains may be introduced during one or more subsequent steps, such as one or more subsequent amplification reactions, e.g., as described in greater detail below. The amplification reaction mixture will include, in addition to the primer extension product composition and universal forward and reverse primers, other reagents, as desired, such polymerase, dNTPs, buffering agents, etc., e.g., as described above.

Amplification conditions may vary. In some instances, the reaction mixture is subjected to polymerase chain reaction (PCR) conditions. PCR conditions include a plurality of reaction cycles, where each reaction cycle includes: (1) a denaturation step, (2) an annealing step, and (3) a polymerization step. The number of reaction cycles will vary depending on the application being performed, and may be 1 or more, including 2 or more, 3 or more, four or more, and in some instances may be 15 or more, such as 20 or more and including 30 or more, where the number of different cycles will typically range from about 12 to 24. The denaturation step includes heating the reaction mixture to an elevated temperature and maintaining the mixture at the elevated temperature for a period of time sufficient for any double stranded or hybridized nucleic acid present in the reaction mixture to dissociate. For denaturation, the temperature of the reaction mixture may be raised to, and maintained at, a temperature ranging from 85 to 100° C., such as from 90 to 98° C. and including 94 to 98° C. for a period of time ranging from 3 to 120 sec, such as 5 to 30 sec. Following denaturation, the reaction mixture will be subjected to conditions sufficient for primer annealing to template DNA present in the mixture. The temperature to which the reaction mixture is lowered to achieve these conditions may be chosen to provide optimal efficiency and specificity, and in some instances ranges from about 50 to 75° C., such as 60 to 74° C. and including 68 to 72° C. Annealing conditions may be maintained for a sufficient period of time, e.g., ranging from 10 sec to 30 min, such as from 10 sec to 5 min. Following annealing of primer to template DNA or during annealing of primer to template DNA, the reaction mixture may be subjected to conditions sufficient to provide for polymerization of nucleotides to the primer ends in manner such that the primer is extended in a 5' to 3' direction using the DNA to which it is hybridized as a template, i.e. conditions sufficient for enzymatic production of primer extension product. To achieve polymerization conditions, the temperature of the reaction mixture may be raised to or maintained at a temperature ranging from 65 to 75, such as from about 68 to 72° C. and maintained for a period of time ranging from 15 sec to 20 min, such as from 20 sec to 5 min. In some embodiments, the annealing stage could be avoided, and protocol could include only denaturation and polymerization steps as described above. The above cycles of denaturation, annealing and polymerization may be performed using an automated device, typically known as a thermal cycler. Thermal cyclers that may be employed are described in U.S. Pat. Nos. 5,612,473; 5,602,756; 5,538,871; and 5,475,610, the disclosures of which are herein incorporated by reference.

The product amplicon composition of this first amplification reaction will include amplicons corresponding to the gene specific domains that are present in the initial target nucleic acid composition and are bounded by primer pairs present in the employed set of gene specific primers and barcode sequence from one side of the amplicon. In some instances, the number of distinct amplicons of differing sequence in this initial amplicon composition ranges from 10 to 19,000, 10 to 15,000, 10 to 10,000, and 10 to 8,000, such as 25 to 18,500, 25 to 12,000, 25 to 8,000, and 25 to 7,500, including 50 to 15,000, 50 to 10,000 and 50 to 5,000, where in some instances the number of distinct amplicons present in this initial amplicon composition is 25 or more, including 50 or more, such as 100 or more, 250 or more, 500 or more, 1,000 or more, 1,500 or more, 2,500 or more, 5,000 or more, 7,500 or more, 8,500 or more, 10,000 or more, 15,000 or more, 18,000 or more. In some instances, this initial amplicon composition includes sequences found in at least a subset of the genes listed in Table 2, e.g., a subset of 10 to 5,000, such as 20 to 5,000, 50 to 5,000, 100 to 5,000, such as 100 to 5,000, including 100 to 4,000, 100 to 3,000, and 100 to 2,000 of the genes listed in Table 2, or in some instances the amplicon composition includes sequences found in all of the genes listed in Table 2. A subject amplicon composition may include or exclude multiple different product amplicons corresponding to same gene as amplified by two or more different primer pairs directed to the gene. The multiple product amplicons making up the amplicon composition may vary in length, ranging in length in some instances from 50 to 1000, such as 60 to 500, including 70 to 250 nt.

The sample barcoded initial product amplicon composition may be employed in a variety of different applications, including evaluation of the expression profile of the sample from which the template target nucleic acid was obtained. In such instances, the expression profile may be obtained from the amplicon composition using any convenient protocol, such as but not limited to differential gene expression analysis, array-based gene expression analysis, NGS sequencing, etc.

For example, the barcoded amplicon composition may be employed in hybridization assays in which a nucleic acid array that displays "probe" nucleic acids for each of the genes to be assayed/profiled in the profile to be generated is employed. In these assays, the amplicon composition is first prepared from the initial target nucleic acid sample being assayed as described above, where preparation may include labeling of the target nucleic acids with a label, e.g., a member of signal producing system. Following amplicon production, e.g., as described above, the sample is contacted with the array under hybridization conditions, whereby complexes are formed between target nucleic acids that are complementary to probe sequences attached to the array surface. The presence of hybridized complexes is then detected, either qualitatively or quantitatively. The detection and quantification of different barcodes could be achieved in the follow-up hybridization steps with labeled targets complementary to barcode domains of the amplicons. Specific hybridization technology which may be practiced to generate the expression profiles employed in the subject methods includes the technology described in U.S. Pat. Nos. 5,143,854; 5,288,644; 5,324,633; 5,432,049; 5,470,710; 5,492,806; 5,503,980; 5,510,270; 5,525,464; 5,547,839; 5,580,732; 5,661,028; 5,800,992; the disclosures of which are herein incorporated by reference; as well as WO 95/21265; WO 96/31622; WO 97/10365; WO 97/27317; EP 373 203; and EP 785 280. In these methods, an array of "probe" nucleic acids that includes a probe for each of the phenotype determinative genes whose expression is being assayed is contacted with target nucleic acids as described above. Contact is carried out under hybridization conditions, e.g., stringent hybridization conditions, and unbound nucleic acid is then removed. The resultant pattern of hybridized nucleic acid provides information regarding expression for each of the genes that have been probed, where the expression information is in terms of whether or not the gene is expressed and, typically, at what level, where the expression data, i.e., expression profile (e.g., in the form of a transcriptome), may be both qualitative and quantitative.

Alternatively, non-array-based methods for quantifying the levels of one or more nucleic acids in a sample may be employed, including quantitative PCR, real-time quantitative PCR, and the like. (For general details concerning real-time PCR see Real-Time PCR: An Essential Guide, K. Edwards et al., eds., Horizon Bioscience, Norwich, U.K. (2004)).

In some embodiments, the method further includes sequencing the multiple barcoded product amplicons, e.g., by using a Next Generation Sequencing (NGS) protocol. In such instances, if not already present, the methods may include modifying the initial amplicon composition to include one or more components employed in a given NGS protocol, e.g., sequencing platform adaptor constructs, indexing domains, clustering domains, etc.

By "sequencing platform adapter construct" is meant a nucleic acid construct that includes at least a portion of a nucleic acid domain (e.g., a sequencing platform adapter nucleic acid sequence) or complement thereof utilized by a sequencing platform of interest, such as a sequencing platform provided by Illumina® (e.g., the NovaSeq™, NexSeq™, HiSeq™, MiSeq™ and/or Genome Analyzer™ sequencing systems); Thermo Fisher (e.g., Ion Torrent™ (such as the Ion PGM™ and/or Ion Proton™ sequencing systems) and Life Technologies™ (such as a SOLID sequencing system)): Pacific Biosciences (e.g., the PACBIO RS II sequencing system); Roche (e.g., the 454 GS FLX+ and/or GS Junior sequencing systems); Oxford Nanopore technologies (e.g., MinION™, GridION™, PrometION™ sequencing systems) or any other sequencing platform of interest.

In certain aspects, the sequencing platform adapter construct includes a nucleic acid domain selected from: a domain (e.g., a "capture site" or "capture sequence") that specifically binds to a surface-attached sequencing platform oligonucleotide (e.g., the P5/i5 or P7/i7 oligonucleotides attached to the surface of a flow cell in an Illumina® sequencing system); where the construct may include one or more additional domains, such as but not limited to: a sequencing primer binding domain or clustering domain (e.g., a domain to which the Read 1 or Read 2 primers of the Illumina® platform may bind); a indexing domain (e.g., a domain that uniquely identifies the sample source of the nucleic acid being sequenced to enable sample multiplexing by marking every molecule from a given sample with a specific index or "tag"); a barcode sequencing primer binding domain (a domain to which a primer used for sequencing a barcode binds); a unique molecular identification domain (e.g., a molecular index tag, such as a randomized tag of 4, 6, or other number of nucleotides) for uniquely marking molecules of interest to determine expression levels based on the number of instances a unique tag is sequenced; a complement of any such domains; or any combination thereof. In certain aspects, a barcode domain (e.g., sample index tag) and a molecular identification domain (e.g., a molecular index tag) may be included in the same nucleic acid.

The sequencing platform adapter constructs may include nucleic acid domains (e.g., "sequencing adapters") of any length and sequence suitable for the sequencing platform of interest. In certain aspects, the nucleic acid domains are from 4 to 200 nucleotides in length. For example, the nucleic acid domains may be from 4 to 100 nucleotides in length, such as from 6 to 75, from 8 to 50, or from 10 to 40 nucleotides in length. According to certain embodiments, the sequencing platform adapter construct includes a nucleic acid domain that is from 2 to 8 nucleotides in length, such as from 9 to 15, from 16-22, from 23-29, or from 30-36 nucleotides in length.

The nucleic acid domains may have a length and sequence that enables a polynucleotide (e.g., an oligonucleotide) employed by the sequencing platform of interest to specifically bind to the nucleic acid domain, e.g., for solid phase amplification and/or sequencing by synthesis of the cDNA insert flanked by the nucleic acid domains. Example nucleic acid domains include the P5 (5'-AATGATACGGCGACCACCGA-3') (SEQ ID NO:03), P7 (5'-CAAGCAGAAGACGGCATACGAGAT-3')(SEQ ID NO:04), Read 1 primer (5'-ACACTCTTTCCCTACACGACGCTCTTCCGATCT-3') (SEQ ID NO:05) and Read 2 primer (5'-GTGACTGGAGTTCAGACGTGTGCTCTTCCGATCT-3') (SEQ ID NO:06) domains employed on the Illumina®-based sequencing platforms. Other example nucleic acid domains include the A adapter (5'-CCATCTCATCCCTGCGTGTCTCCGACTCAG-3')(SEQ ID NO:07) and P1 adapter (5'-CCTCTCTATGGGCAGTCGGTGAT-3')(SEQ ID NO:08) domains employed on the Ion Torrent™-based sequencing platforms.

The nucleotide sequences of nucleic acid domains useful for sequencing on a sequencing platform of interest may vary and/or change over time. Adapter sequences are typically provided by the manufacturer of the sequencing platform (e.g., in technical documents provided with the sequencing system and/or available on the manufacturer's website). Based on such information, the sequence of the sequencing platform adapter construct of the template switch oligonucleotide (and optionally, a first strand synthesis primer, amplification primers, and/or the like) may be designed to include all or a portion of one or more nucleic acid domains in a configuration that enables sequencing the nucleic acid insert (corresponding to the template nucleic acid) on the platform of interest.

The sequencing adaptors may be added to the amplicons of the initial amplicon composition using any convenient protocol, where suitable protocols that may be employed include, but are not limited to: amplification protocols, ligation protocols, etc. In some instances, amplification protocols are employed. In such instances, the initial amplicon composition may be combined with forward and reverse sequencing adaptor primers that include one or more sequencing adaptor domains, e.g., as described above, as well as domains that bind to universal primer sites found in all of the amplicons in the composition, e.g., the forward and reverse anchor domains, such as described above. As reviewed above, amplification conditions may include the addition of forward and reverse sequencing adaptor primers configured to bind to the common forward and reverse anchor domains and thereby amplify all or a desired portion of the product nucleic acid, dNTPs, and a polymerase suitable for effecting the amplification (e.g., a thermostable polymerase for polymerase chain reaction), where examples of such conditions are further described above. The forward and reverse sequencing adaptor primers employed in these embodiments may vary in length, ranging in length in some instances from 20 to 60 nt, such as 25 to 50 nt. Addition of NGS sequencing adaptors results in the production of a composition which is configured for sequencing by an NGS sequencing protocol, i.e., an NGS library.

In certain aspects, the methods of the present disclosure further include subjecting the NGS library to NGS protocol, e.g., as described above. The NGS protocol will vary depending on the particular NGS sequencing system employed. Detailed protocols for sequencing an NGS library, e.g., which may include further amplification (e.g., solid-phase amplification), sequencing the amplicons, and analyzing the sequencing data are available from the manufacturer of the NGS system employed. Protocols for performing next generation sequencing, including methods of processing the sequencing data, e.g., to count and tally sequences and assemble transcriptome data therefrom, are further described in published United States Patent Application 20150344938, the disclosure of which is herein incorporated by reference.

Pooling

Where desired, a given workflow may include a pooling step where a product composition, e.g., made up of synthesized first strand cDNAs or synthesized double stranded cDNAs, is combined or pooled with product compositions obtained from one or more additional samples, e.g., cells. The number of different product compositions produced from different samples, e.g., cells, that are combined or pooled in such embodiments may vary, where the number ranges in some instances from 2 to 50,000, such as 3 to 25,000, including 4 to 20,000 such as 5 to 10,000, where in some instances the number ranges from 100 to 10,000, such as 1,000 to 5,000. Prior to or after pooling, the product composition(s) can be amplified, e.g., by polymerase chain reaction (PCR), such as described above.

Template Switch

In some embodiments, the primer reaction extension conditions using RNA template could incorporate a template switching oligonucleotide, e.g., with optional sample-specific barcode domain and anchor domain. Template switch is described in U.S. Pat. Nos. 5,962,271 and 5,962,272, as well as Published PCT application Publication No. WO2015/027135; the disclosures of which are herein incorporated by reference. Under the primer extension conditions, the template switching oligonucleotide could be employed by reverse transcriptase as a second template in the primer extension reaction. As a result of this extension reaction, the sample-specific barcode sequences of the template switch oligonucleotide will be incorporated to the 3'-end of the synthesized cDNA. In another embodiment, in addition to template switching oligonucleotide the extension reaction could also include a set of gene-specific oligonucleotides complementary to the target regions of RNA templates. This set of gene-specific oligonucleotides is designed as complementary sequences to the gene-specific portion of forward gene-specific primers and with the sequences or modification at the 3'-end which block extension of these oligonucleotides by reverse transcriptase. Under this disclosed condition, the RNase H activity of reverse transcriptase (or RNAse H enzyme which could be added externally), will degrade the RNA target region complementary to the gene-specific oligonucleotide, thus generating target RNA template truncated at the sites selected for design of forward gene-specific primers. Using of target RNA templates specifically truncated at the sites of forward gene-specific primers will allow to add at this site the sample-specific barcode encoded by template switching oligonucleotide by extension of reverse gene-specific primers with reverse transcriptase. Therefore, the extension reaction composition comprising target RNAs, barcoded template switching oligonucleotides, oligonucleotides complementary to gene-specific portion of forward gene-specific primers and reverse gene-specific primers allow to specifically extend and barcode the target amplicon regions in a single reaction step catalyzed by reverse transcriptase.

Utility

The subject methods find use in a variety of applications, including expression profiling or transcriptome determination applications, where a sample is evaluated to obtain an expression profile of the sample. By "expression profile" is meant the expression level of a gene of interest in a sample, which may be a single cell or a combination of multiple cells (e.g., as determined by quantitating the level of an RNA or protein encoded by the gene of interest), or a set of expression levels of a plurality (e.g., 2 or more) of genes of interest. In certain aspects, the expression profile includes expression level data for 1, 2 or more, 5 or more, 10 or more, 20 or more, 50 or more, 100 or more, 200 or more, 300 or more, 400 or more, 500 or more, 1,000 or more, 5,000 or more, 10,000 or more, 15,000 or more, e.g., 18,000 or more genes of interest. According to one embodiment, the expression profile includes expression level data of from 50 to 8000 genes of interest, e.g., from 1000 to 5000 genes of interest. In some embodiments, the expression profile includes expression level data of from 50 to 19,000 genes of interest, e.g., from 1000 to 18,000 genes of interest. In certain aspects, the methods may be employed detecting and/or quantitating the expression of all or substantially all of the cancer associated genes transcribed in a target cell. In a preferred embodiment, the methods are described for profiling all known cell and tissue marker genes, as listed in Table 2. In certain aspects, the methods may be employed detecting and/or quantitating the expression of all or substantially all of the genes transcribed by an organism, e.g., a mammal, such as a human or mouse, in a target cell. The terms "expression" and "gene expression" include transcription and/or translation of nucleic acid material. For example, gene expression profiling may include detecting and/or quantitating one or more of any RNA species transcribed from the genomic DNA of the target cell, including pre-mRNAs, mRNAs, non-coding RNAs, microRNAs, small RNAs, regulatory RNAs, and any combination thereof.

Expression levels of an expressed sequence are optionally normalized by reference or comparison to the expression level(s) of one or more control expressed genes, including but not limited to, ACTB, GAPDH, HPRT-1, RPL25, RPS30, and combinations thereof. These "normalization genes" have expression levels that are relatively constant among target cells in the cellular sample.

In some instances, quantitative analysis of gene expression using set of calibration control template composition is performed. Internal calibration control templates which mimic but differ from natural target RNAs and spiked into cell or cell lysates at specific amount may be effectively used for truly quantitative expression analysis. The calibration control RNAs could be developed for the set of genes (e.g. cell marker genes) or for genome-wide set of transcripts. In order to address the reproducibility of the profiling assay for multiple biological samples (e.g. thousands of single cells), embodiments of the invention uniquely employ the strategy of using barcoded reverse gene specific primers. Target template RNAs (e.g., present in cell extracts) hybridized with barcoded reverse gene specific primers could be combined for the all follow-up steps. The strategy of barcoding and combining target RNAs at early (hybridization) stage allows for significantly reduced cost of the assay, eliminates sample-to-sample profiling variability due to differences in experimental assay conditions, etc. The developed protocol which addresses sample-to-sample and batch effect variability has significant utility in biomarker discovery in clinical samples (e.g., whole blood).

According to certain embodiments, the expression profile includes "binary" or "qualitative" information regarding the expression of each gene of interest in a target cell. That is, in such embodiments, for each gene of interest, the expression profile only includes information that the gene is expressed or not expressed (e.g., above an established threshold level) in the sample being analyzed, e.g., tissue, cell, etc. In other embodiments, the expression profile includes quantitative information regarding the level of expression (e.g., based on rate of transcription, rate of splicing and/or RNA abundance) of one or more genes of interest. A qualitative and/or quantitative expression profile from the sample may be compared to, e.g., a comparable expression profile generated from other samples and/or one or more reference profiles from cells known to have a particular biological phenotype or condition (e.g., a disease condition, such as a tumor cell; or treatment condition, such as a cell treated with an agent, e.g., a drug). When the profiles being compared are quantitative expression profiles, the comparison may include determining a fold-difference between one or more genes in the expression profile of a target cell and the corresponding genes in the expression profile(s) of one or more different target cells in the cellular sample, or the corresponding genes in a reference cell or cellular sample. Alternatively, or additionally, the expression profile may include information regarding the relative expression levels of different genes in a single target cell. In certain aspects, the fold difference in intercellular expression levels or intracellular expression levels can be determined to be 0.1 or more, 0.5 fold or more, 1 fold or more, 1.5 fold or more, 2 fold or more, 2.5 fold or more, 3 fold or more, 4 fold or more, 5 fold or more, 6 fold or more, 7 fold or more, 8 fold or more, 9 fold or more, or more than 10 fold or more, for example.

In some instances, the methods may be employed to determine the transcriptome of a sample. The term “transcriptome” is employed in its conventional sense to refer to the set of all messenger RNA molecules in one cell or a population of cells. In some instances, a transcriptome includes the amount or concentration of each RNA molecule in addition to the molecular identities. The methods described herein may be employed in detecting and/or quantitating the expression of all genes or substantially all genes of the transcriptome of an organism, e.g., a mammalian organism, such as a human or a mouse, for a particular target cell or a population of cells.

Expression profiles obtained using methods of the invention may be employed in a variety of applications. For example, an expression profile may be indicative of the biological condition of the sample or host from which the sample is obtained, including but not limited to a disease condition (e.g., a cancerous condition, metastatic potential, an epithelial mesenchymal transition (EMT) characteristic, and/or any other disease condition of interest), the condition of the cell in response to treatment with any physical action (e.g., heat shock, hypoxia, normoxia, hydrodynamic stress, radiation, and/or the like), the condition of the cell in response to treatment with chemical compounds (e.g., drugs, cytotoxic agents, nutrients, salts, and/or the like) or biological extracts or entities (e.g., viruses, bacteria, other cell types, growth factors, biologics, and/or the like), and/or any other biological condition of interest (e.g. immune response, senescence, inflammation, motility, and/or the like).

Embodiments of the invention find further application in tumor microenvironment analysis applications. Transcriptome data obtained, e.g., as described above, may be employed to determine the cellular constitution of a tumor sample, e.g., to provide an evaluation of the types of cells present in a tumor sample, such as infiltrating hematopoietic cells, tumor cells and bulk tissue cells. For example, transcriptome data may be employed to assess whether a tumor sample does not include infiltrating immune cells, including those of the adaptive and/or innate immune system, such as but not limited to: T, B, natural killer, monocyte, granulocytes, neutrophils, basophils, platelets, and their myeloid and lymphoid progenitor cells, hematopoietic stem cells, and the like. Such information may be used, e.g., in therapy determination applications, for example where the presence of infiltrating immune cells indicates that a patient will be responsive to immunotherapy while the absence of infiltrating immune cells indicates that a patient will not be responsive to immunotherapy. As such, aspects of the invention include methods of therapy determination, where a patient tumor sample is evaluated to assess the tumor microenvironment. Aspects of the invention may further include making a determination to employ an immunotherapy protocol is made if the tumor microenvironment includes infiltrating tumor cells and a determination is made to employ a non-immunotherapy treatment regimen if the tumor microenvironment lacks infiltrating immune cells.

Methods as described here also find use in large-scale profiling of single-cell phenotypes derived from model system (e.g., cultivated cells, organoid cultures, 3D cultures, etc.), model organisms (e.g., mice, rat, monkey, etc.) and clinical samples derived from normal or pathological conditions (e.g., blood, biopsy, sputum, saliva, etc.). Currently, there is a substantial need for comprehensive characterization of different cell types present in normal and pathological conditions. The disclosed methods and compositions provide an improved technological platform for large-scale discovery of key cellular markers for developing novel diagnostic and prognostic tools.

Transcriptome data, e.g., produced as described above, also finds use in other non-clinical applications, such as predictive and prognostic biomarker discovery applications, evaluation of cancer immunoediting mechanism applications, drug target discovery, and the like.

Compositions

Aspects of the invention further include various compositions. Compositions of the invention may include, e.g., one or more of any of the reaction mixture components described above with respect to the subject methods, where the reaction mixtures may be present in a nucleic acid amplification device, such as in a container of such a device. For example, the compositions may include one or more of a target nucleic acid template (e.g., genomic DNA sample, cDNA sample, RNA sample, etc.), individual cells or group of cells, a polymerase (e.g., a thermostable polymerase), ligase, a set of gene specific primers, barcoded oligonucleotides (e.g., donor nucleic acids), primers for cDNA synthesis, dNTPs, NAD, ATP, a salt, a metal cofactor, one or more nuclease inhibitors (e.g., an RNase inhibitor), one or more enzyme-stabilizing components (e.g., DTT), or any other desired reaction mixture component(s). Composition may vary for the different steps of the disclosed methods. For example, for cDNA synthesis steps the compositions may include only reagents necessary for reverse transcription and for the subsequent ligation step the composition may employ a different buffer, oligonucleotides and enzymes (DNA ligase) components. Some components of composition (e.g., barcoded oligonucleotides), may be immobilized on a solid surface (e.g., plate wall, beads, etc.). Also provided are compositions that include a primer extension product composition, and barcoded primer extension product composition, e.g., as described above. Also provided are barcoded amplicon compositions and NGS libraries, such as described above.

In certain embodiments disclosed in the application, the different compositions are physically separated from each other, e.g., they are present or deposited in different wells or plate or in microdroplets. For example, compositions comprising a plurality of single barcoded oligonucleotides immobilized on bead and single cell sample could be present in each microdroplet. In other embodiments, the plurality of barcoded compositions (e.g., hybridization complexes between target RNAs and barcoded reverse gene specific primers or barcoded primer extension product compositions) are mixed together and used as a mix of different compositions in all follow-up steps. In such instances, the different compositions may include the common components necessary to perform hybridization, enzymatic modification, e.g., primer extension, purification, etc. steps and unique components which are specific for each biological sample, e.g., individual cells, purified nucleic acid from each sample, and sample-specific barcoded oligonucleotide, as described in a more details above.

The subject compositions may be present in any suitable environment. According to one embodiment, the compositions are present in reaction tubes (e.g., a 0.2 mL tube, a 0.5 mL tube, a 1.5 mL tube, or the like) or a well. In certain aspects, the compositions are present in two or more (e.g., a plurality of) reaction tubes or wells (e.g., a plate, such as a 96-well plate). The tubes and/or plates may be made of any suitable material, e.g., polypropylene, or the like. In certain aspects, the tubes and/or plates in which the composition is present provide for efficient heat transfer to the composition (e.g., when placed in a heat block, water bath, thermocycler, and/or the like), so that the temperature of the composition may be altered within a short period of time, e.g., as necessary for a particular hybridization or enzymatic reaction to occur. According to certain embodiments, the composition is present in a thin-walled polypropylene tube, or a plate having thin-walled polypropylene wells. Other suitable environments for the subject compositions include, e.g., a microfluidic chip (e.g., a "lab-on-a-chip device"). The composition may be present in an instrument configured to bring the composition to a desired temperature, e.g., a temperature-controlled water bath, heat block, or the like. The instrument configured to bring the composition to a desired temperature may be configured to bring the composition to a series of different desired temperatures, each for a suitable period of time (e.g., the instrument may be a thermocycler).

In another embodiment, the different compositions are present or delivered to microwells of microplates with well sizes dimensioned to accommodate individual cells, where the dimensions may be configured to accommodate on average no more than 2 cells, such as no more than 1 cell. Examples of such wells are those found in the plates of the Rhapsody instrument (Becton, Dickinson and Company), the ICELL8 instrument (Takara Bio USA), etc. where such instruments employ plates having approximately 10,000 wells and a deposition protocol for individual cells and single beads.

In another embodiment, the different compositions are present in microdroplets. For example, emulsion PCR may be employed. For emulsion PCR, an emulsion PCR reaction (e.g., in a droplet, droplet microreactor) is created with a "water in oil" mix to generate thousands or millions of micron-sized aqueous compartments. Sources of nucleic acids (e.g., cells, nucleic acid libraries, optionally coupled to solid supports. e.g., beads) are mixed in a limiting dilution prior to emulsification or directly into the emulsion mix. The combination of compartment size and limiting dilution of the nucleic acid sources is used to generate compartments containing, on average, just one source of nucleic acid (e.g., cell, or sample nucleic acid(s), such as cellular nucleic acid—e.g., RNA combined with a solid support, such that the nucleic acids may be stably associated with the solid support (e.g., bead) etc.). Depending on the size of the aqueous compartments generated during the emulsification step, up to 3×109 individual amplification reactions per μl can be conducted simultaneously in the same container, e.g., tube, well, or other suitable container. The average size of a compartment in an emulsion ranges from sub-micron in diameter to over 100 microns, depending on the emulsification conditions. Protocols that may be employed include those that allow one to deliver individual cells with unique barcoded beads and reagents necessary for reverse transcription step into separate microdroplets. Such microdroplet technologies include the Chromium instrument (10× Genomics), the ddSeq instrument (Bio-Rad), etc. Microdroplets that include compositions as described above may also be generated and delivered to separate compartments or to oil (to form water-oil droplets) using conventional technologies, e.g., FACS, ink-jet deposition, etc.

Kits

Aspects of the present disclosure also include kits. The kits may include, e.g., one or more of any of the reaction mixture components described above with respect to the subject methods. For example, the kits may include one or more of: a set of gene specific primers, barcoded oligonucleotides (e.g., donor nucleic acids, e.g., immobilized on the beads), a polymerase (e.g., a thermostable polymerase, a reverse transcriptase, or the like), ligase (e.g. DNA ligase), dNTPs, a salt, a metal cofactor, NAD, ATP, one or more nuclease inhibitors (e.g., an RNase inhibitor and/or a DNase inhibitor), one or more molecular crowding agents (e.g., polyethylene glycol, or the like), one or more enzyme-stabilizing components (e.g., DTT), or any other desired kit component(s), such as solid supports. e.g., tubes, beads, microfluidic chips, etc.

Components of the kits may be present in separate containers, or multiple components may be present in a single container. For example, the individual barcoded oligonucleotides could be provided pre-aliquoted in separate wells or attached/encapsulated with different beads, and mixture of all beads is provided as kit components. In certain embodiments, it may be convenient to provide the components in a lyophilized form, so that they are ready to use and can be stored conveniently at room temperature.

In addition to the above-mentioned components, a subject kit may further include instructions for using the components of the kit, e.g., to practice the subject method. The instructions are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, Hard Disk Drive (HDD), portable flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

The following examples are offered by way of illustration and not by way of limitation.

EXPERIMENTAL

I. Barcoding Via Reverse Gene Specific Primer Extension

The objective of this experiment is to demonstrate performance of expression profiling in sorted cells or cell mixes using a set of gene specific primers pairs, i.e., the 1.3K Cell-Tissue Marker primer set (1.3K hCTM) as detailed Table 2 using the protocol illustrated in FIG. 1.

A. Hybridization of Gene-Specific Primers and Sample-Barcoded Donor Nucleic Acid to mRNA Sample Individual cells are isolated using a microfluidic cartridge or sorting technology. Each of the individual cells (or cell samples) are mixed with TLC lysis buffer (Qiagen)(e.g. 5-μl for single cell), RevGSP-L1 primers (1.3K human Cell Marker primer set, Table 2) and a set of T30-Anc2-BC-UMI-L2 donor nucleic acids immobilized on beads (ChemGenes) (where each set of donor nucleic acids for each cell varies only by the UMI domain and each cell contacted with its own unique set of donor nucleic acids that differs from any other set used with the any other cell by the BC domain). The donor nucleic acids and RevGSP-L1 Primers are hybridized to the cellular RNA at 50° C. for 30 min. The structures of the donor nucleic acid and RevGSP primers employed in this step are provided below:

```
RevGSP-L1 Primer:
                                                 (SEQ ID NO: 09)
                L1 domain
3'<RevGSP-AGCACCGACCAGCACCp-5'

T30-Anc2-UMI-BC-L2:
                                                 (SEQ ID NO: 10)
                  L2 domain             Anchor 2 domain
3'GCCAGCACGCCACCA-(UMI-BC)AGACACGACCAGCCACGA(INVT30)-Bead
```

An example of a T30-Anc2-UMI-BC-L2 donor nucleic acid showing an exemplary UMI8 domain (unique molecular identifier of 8 residues in length) and a BC14 domain (sample barcode of 14 residues in length) is provided below:

```
                                                                         (SEQ ID NO: 11)
  T30VN                                   Anc2      UMI8       BC14            L2
TTTTTTTTTTTTTTTTTTTTTTTTTTTTTTVNAGCACCGACCAGCAVVNVVNVVGCCCAGGAAGAACGAACCACCGCACGACCG
```

Beads with immobilized mRNA, dT30-Anc2-BC-UMI and RevGSP-L2 primers produced from different cells/samples are then pooled together and washed with TCW buffer (Qiagen).

B. Ligation of Gene Specific Primers to Donor Nucleic Acids

The double-stranded complexes formed between polyA+ mRNA, T30-Anc2-UMI-BC-L2 donor nucleic acid and RevGSP-L1 Primer as shown in FIG. 1 are then contacted under hybridization conditions with a complementary ligation linker oligonucleotide (L1-L2) having the following sequence:

```
                                   (SEQ ID NO: 12)
A-TCGTGGCTGGTCGTGG--CGGTCGTGCGGTGGT-3'dT
                 L1-L2
```

Specifically, beads with immobilized complex between polyA+ mRNA and T30-Anc2-UMI-BC-L2 and Rev-GSP-L1 as described above are mixed with 10-μl of Multiplex Reverse Transcription master mix (DriverMap kit, Cellecta, Inc. Mountain View, CA), where the mix includes the L1-L2 ligation linker (20 nM), Ampligase (Epicentre, 1/250 dilution) and NAD (1 mM) as well as all reagents required for reverse transcription. The resultant reaction mixture is incubated at 50° C. for 30 min. The beads are treated with 1-μl of ExoI (20 units/μl, New England Biolabs) at 37° C., 30 min, and washed with TCW buffer.

As a result, the L1 and L2 domains of the RT and RevGSP primers are brought together as shown in FIG. 1 and also illustrated in the following structure:

```
                                                                   (SEQ ID NOs: 12, 13 and 14)
3'             L1         5' 3'    L2                                T30-Anc2-BC-UMI       5'
<RevGSP-AGCACCGACCAGCACCp GCCAGCACGCCACCA-(BC14-UMI8)-AGACACGACCAGCCACGA(NVT30)-Bead
      A-TCGTGGCTGGTCGTGG--CGGTCGTGCGGTGGT-3'dT <Anc2
                       L1-L2
```

The Ampligase catalyzes ligation between the L1 and L2 domains resulting in the BC14, UMI8 and Anc2 domains being transferred to the reverse gene specific primer, such that the reverse gene specific primer is labeled with BC14-UMI8-Anc2 domains necessary for barcoding and amplification of gene specific extension products as described in the following steps. First strand cDNA is also synthesized in this step, as illustrated in FIG. 1.

C. Forward (FWD) GSP Extension-Second Strand cDNA Production

Resultant barcoded first strand cDNA products immobilized on beads produced in Step B, above, are subjected to a second round of extension to produce second strand cDNA. For this step, Anchor 1-Fwd GSP primers (1.3K hCTM primers) are employed, having the structure:

```
                                   (SEQ ID NO: 15)
         Anchor 1
   5' AGCAGCACCGACCAGCAGACA-Fwd GSP-3'
```

In this step, the barcoded cDNA products immobilized on beads produced in Step B, above, are combined with 10-μl of Extension master mix (DriverMap kit, Cellecta, Inc., Mountain View, CA) that includes 1 nM of each Anchor 1-Fwd GSP primer and DNA polymerase at 64° C. for 30 min, followed by treatment with 1-μl of ExoI (20 units/ul, New England Biolabs) at 37° C. for 30 min. The beads are then washed with TCW buffer.

D. 1st PCR

Anchored DNA fragments produced in Step C are amplified in 50-μl of Multiplex DNA polymerase reaction mix (DriverMap kit) with universal anchor PCR primers (Fwd-Anc1 and Rev-Anc2) as shown below for 14-20 cycles.

```
PCR primers for 1st PCR Step:
Fwd-Anc1
                                   (SEQ ID NO: 16)
AGCAGCACCGACCAGCAGACA

Rev-Anc2
                                   (SEQ ID NO: 17)
ACGAGCACCGACCAGCACAGA
```

This first round of PCR results in production of sample-barcoded anchor-domain-flanked double-stranded gene specific DNA fragments having the following structure:

```
                                                                                  (SEQ ID NOS: 18 and 19)
       Anc1         Fwd                L2             L1
AGCAGCACCGACCAGCAGACA-GSP>sDNA--GSP-ACCACCGCACGACCGCCACGACCAGCCACGA-(BC14-UMI8)-TCTGTGCTGGTCGGTGCTCGT
TCGTCGTGGCTGGTCGTCTGT-GSP>asDNA-GSP-TGGTGGCGTGCTGGCGGTGCTGGTCGGTGCT-(BC14-UMI8)-AGACACGACCAGCCACGAGCA
                                Rev                                                  Anc2
```

The resultant adaptor containing sample-barcoded anchor-domain-flanked double-stranded gene specific DNA fragments are analyzed by gel (if necessary, combined at equal amount based on the smear analysis (180-400 bp range) for several samples), and purified using 1.8V of AMPpure magnetic beads (Beckman Coulter). The purified cDNA products are quantitated by Qubit fluorescence measurement, and diluted to 10 nM (2 ng/μl) for next-generation sequencing using NextSeq500 Illumina platform.

II. Variations of Example 1 Protocol

A. In a variation of the protocol described in Example I, only RevGSP-L1 primers are hybridized with polyA+ mRNA in solution following which the resultant hybridization complexes are purified. The purified hybridization complexes are then combined T30-Anc2-UMI-BC-L2 donor nucleic acids or a variant thereof lacking the T30 domain in the presence of the L1-L2 ligation linker under ligation conditions to join the BC-UMI domains to the RevGSP-L1 primers.

B. In a second variation of the protocol described in Example I, RevGSP-L1 primers are hybridized with polyA+ mRNA in conjunction with oligo dT immobilized on beads or test tubes following which the resultant hybridization complexes are purified. The purified hybridization complexes are then combined Anc2-UMI-BC-L2 in the presence of the L1-L2 ligation linker under ligation conditions to join the BC-UMI domains to the RevGSP-L1 primers.

E. $2_{nd}$ PCR

2-μl aliquot of the 1st PCR amplicon product produced in Step D, above, is added to multiplex DNA polymerase reaction mix (50-μl) and amplified using P7-Anc1 and P5-Anc2 PCR primers with different indexes, as shown below:

```
2nd PCR amplification primers:
P7-Anc1
                                          (SEQ ID NO: 20)
          P7                    Anc1
AGCAGAAGACGGCATACGAGATAGCAGCACCGACCAGCAGACA

P5-Anc2
                                          (SEQ ID NO: 21)
          P5                     Anc2
ACGGCGACCACCGAGATCTACAC ACGAGCACCGACCAGCACAGA
```

The reaction mixture is amplified for 7 cycles, treated with ExoI (0.5 μl) at 37° C. for 30 min. The resultant adaptor containing sample-barcoded anchor-domain-flanked double-stranded gene specific DNA fragments have the following structure:

```
                                                         (SEQ ID NOs: 22 and 23)
       Anc1         Fwd                L2             L1
P7-AGCAGCACCGACCAGCAGACA-GSP>sDNA--GSP-ACCACCGCACGACCGCCACGACCAGCCACGA-(BC14-UMI8)-
TCTGTGCTGGTCGGTGCTCGT-P5
P7-TCGTCGTGGCTGGTCGTCTGT-GSP>asDNA-GSP-TGGTGGCGTGCTGGCGGTGCTGGTCGGTGCT-(BC14-UMI8)-

                                      Rev
AGACACGACCAGCCACGAGCA-P5
     Anc2
```

III. Barcoding Via Circular Intermediate

A. First Strand cDNA Synthesis.

50 ng of total RNA (human Brain RNA, Thermo-Fisher) is mixed with a set of T25-Anc1-UMI-BC-L2 donor nucleic acids that differ from each other with respect to the UMI domain at a 1 μM final concentration. Each of the T25-Anc1-UMI-BC-L2 donor nucleic acids is an oligo dT primer configured for cDNA synthesis, where the primers include a sample specific barcode domain (BC14), universal molecular index domain (UMI8), a ligation linker domain (L2), anchor domain (Anc1) and template binding domain (oligo dT25VN). The T25-Anc1-UMI-BC-L2 donor nucleic acids have the following structure:

```
                                        (SEQ ID NO: 24)
L2             BC14          UMI8       Anc1          dT25VN
CGGTCGTGCGGTGGTTCGGCTTCCTGGGCBBNBBNBBTGTCTGCTGGTCGGTGCTTTTTTTTTTTTTTTTTTTTTTTTTVN
```

The resultant reaction mixture is treated at 72° C. for 2 min, cooled to 4° C. and reverse transcribed in 1×RT reaction buffer using Maxima reverse transcriptase (Thermo-Fisher) at 50° C. for 30 min in 10-μl reaction mix (Thermo-Fisher), following which RT is inactivated at 95° C. for 5 min. The resultant first strand cDNA product composition is combined with a second first strand cDNA product composition prepared from 50 ng human universal RNA (Agilent Technologies) from a second set of T25-Anc1-UMI-BC-L2 RT primers having a BC domain different from that used with the human Brain RNA. The resultant pooled samples are purified using RNA/DNA micro isolation kit (Qiagen) using manufacturer protocol and eluted in 14-μl of water.

B. Forward Gene-Specific Primer Extension Second Strand cDNA Synthesis and Ligation Step.

14 μl of the first strand cDNA composition produced as described in Step A, above, is mixed with 11 μl of Multiplex DNA polymerase master reaction mix (DriverMap kit, Cellecta) that includes the pool of L-1 Forward 1.3K CTM GSP primers (Table 2) (final concentration 1 nM of each primer). The L-1 Forward gene specific primers (L-1 Fwd GSPs) have the following structure:

```
L1-Fwd GSP
                             (SEQ ID NO: 25)
  L1
CCACGACCAGCCACGA-FWd GSP
```

Hybridized L1-Fwd GSPs are extended for 1 cycle at 64° C. extension temperature (30 min), treated with 1-μl of ExoI (New England BioLabs) for 30 min at 37° C., and 95° C. for 5 min.

The resultant forward gene specific primer extension product composition (i.e., second strand cDNA composition) is then mixed with DNA ligation master mix (5-μl) that includes DNA polymerase master mix with L1-L2 ligation linker oligonucleoptide (20 nM) complementary to the both ends of the forward primer driven second strand cDNA and 1×buffer with AmpliTaq DNA ligase (10 units, Epicentre), 1 mM NAD (Sigma). The L1-L2 ligation linker has the following structure:

```
                                       (SEQ ID NO: 26)
ATCGTGGCTGGTCGTGGCGGTCGTGCGGTGGTA/3InvdT/
```

Combination of the forward gene specific primer extension product (second strand cDNA) composition with the L1-L2 linker results in production of a circular nucleic acid loop intermediate made up of the second strand cDNA whose ends are held together by the L1-L2 linker, as illustrated below:

The resultant reaction mixture is ligated for 5 cycles: (95° C. for 20 sec, 65° C. for 1 min). Ligated circle products are purified by AMPpure beads (1.8×volume, Beckman Coulter) according to manufacturer's protocol. In the course of ligation of the above circular intermediate by DNA ligase (between L1 and L2 linker domains), the universal primer binding domain (Anc1), unique molecular index domain (UMI8) and sample barcode domain (BC14) are transferred to the forward gene specific domain in the final single-stranded circular structure, as illustrated in FIG. 2.

C. Reverse Gene Specific Primer Extension Step

The ligated second strand circular cDNA composition produced is Step B, above, is then subjected to a reverse gene specific primer (RevGSP) round of extension with 5-μl of DNA polymerase master mix that includes 1.3K CTM reverse gene specific primers which include a second anchor domain, i.e., Anc2. The Anc2-Rev GSPs have the following structure:

```
Anc2-Rev GSP
                                   (SEQ ID NO: 29)
      Anc2
ACGAGCACCGACCAGCACAGA-Rev GSP
```

For this step, the same conditions as employed for the first forward gene-specific primer extension step are used, and the resultant product is treated with 1-μl of ExoI at 37° C. for 30 min, and 95° C. for 5 min.

D. First PCR

Anchored cDNA fragments produced in Step C, above, are then amplified in 100-μl of Multiplex DNA polymerase reaction mix (DriverMap kit, Cellecta) with universal anchor PCR primers (Anc1 and Anc2) for 16 PCR cycles (98° C. for 10 sec, 72° C. for 20 sec). The universal anchor PCR primers have the following structures:

```
Anc1
                              (SEQ ID NO: 30)
AGCAGCACCGACCAGCAGACA

Anc2
                              (SEQ ID NO: 31)
ACGAGCACCGACCAGCACAGA
```

This first PCR results in the production of sample-barcoded anchor-domain-flanked double-stranded gene specific deoxyribonucleic acid (DNA) fragments having the structure:

```
Amplicon Structure after 1st PCR step.
                                (SEQ ID NOs: 32 and 33)
             Anc1>                            L2-L1
AGCAGCACCGACCAGCAGACA-(UMI8-BC14)-ACCACCGCACGACCGC

             Fwd
CACGACCAGCCACGA-GSP>SDNA--GSP-TCTGTGCTGGTCGGTGCTCG

T
```

```
                                                  (SEQ ID NOs: 26, 27 and 28)
             Anc1                          L2      3' 5'    L1        Fwd
Loop-sDNA-A25--AGCACCGACCAGCAGACA-(UMI8-BC14)-ACCACCGCACGACCG pCCACGACCAGCCACGA-GSP>sDNA-Loop
                                        3'dT-TGGTGGCGTGCTGGC--GGTGCTGGTCGGTGCT-A
                                                     L1-L2linker
```

-continued

```
TCGTCGTGGCTGGTCGTCTGT-(UMI8-BC14)-TGGTGGCGTGCTGGCG
                                 MB-Ind

GTGCTGGTCGGTGCT-GSP>ASDNA-GSP-AGACACGACCAGCCACGAGC
                                     Rev        <Anc2

A
```

E. Second PCR

A 5-μl aliquot of the first PCR product produced as described in Step D, above, is combined with Multiplex DNA polymerase reaction mix (100-μl) and amplified using forward and reverse PCR primers (P7-Anc and P5-Anc2) for 8 cycles. The forward and reverse PCR primers (P7-Anc1 and P5-Anc2) primers have the following structure:

```
P7-Anc1
                                         (SEQ ID NO: 34)
AGCAGAAGACGGCATACGAGATAGCAGCACCGACCAGCAGACA

P5-Anc2
                                         (SEQ ID NO: 35)
ACGGCGACCACCGAGATCTACACACGAGCACCGACCAGCACAGA
```

The resultant amplicon composition is treated with ExoI (1-μl) at 37° C. for 30 min. This first PCR results in the production of sequencing adaptor containing sample-barcoded anchor-domain-flanked double-stranded gene specific deoxyribonucleic acid (DNA) fragments having the structure:

```
Amplicon structure after second PCR step.
                                   (SEQ ID NOs: 36 and 37)
P7                                      Anc1
AGCAGAAGACGGCATACGAGATAGCAGCAGCACCGACCAGCAGACA-

                              L2-L1                    Fwd
(UMI8-BC14)ACCACCGCACGACCGCCACGACCAGCCACGA-GSP>

sDNA-

TCGTCTTCYGCCGTATGCTCTATCGTCGTCGTGGCTGGTCGTCTGT-

(UMI8-BC14)TGGTGGCGTGCTGGCGGTGCTGGTCGGTGCT-GSP>

asDNA

--sDNA-GSP-TCTGTGCTGGYCGGTGCTCGTCGTGTGTAGATCTCG

GTGGTCGCCGT

-asDNA-GSP-AGACACGACCAGCCACGAGCAGCACACATCTAGAGC
         Rev    Anc2

CACCAGCGGCA
        P5
```

The resultant adaptor containing sample-barcoded anchor-domain-flanked double-stranded gene specific deoxyribonucleic acid (DNA) fragments are analyzed by gel and combined at equal amount based on the smear analysis (220-480 bp range) and purified using AMPpure magnetic beads (1.8×volume, Beckman Coulter) according to the manufacturer's protocol.

The purified adaptor containing sample-barcoded anchor-domain-flanked double-stranded gene specific deoxyribonucleic acid (DNA) fragments are quantitated by OD260 measurement, and diluted to 10 nM (2.2 ng/μl) for next-generation sequencing in NextSeq500 Illumina platform using the following program: Read 1: RevSS-SeqDNA>34cycles; Ind 1:RevSS-SeqInd>14cycles; Ind 2: FwdSS-SeqMB>8cycles; Read 2: FwdSS-SeqDNA>34cycles. The sequencing primers have the following structure:

```
FwdSS-SeqDNA
                              (SEQ ID NO: 38)
ACGACCGCCACGACCAGCCACGA

FwdSS-SeqMB
                              (SEQ ID NO: 39)
ACGAGATAGCAGCACCGACCAGCAGACA

RevSS-SeqDNA
                              (SEQ ID NO: 40)
ACTACACACGAGCACCGACCAGCACAGA

RevSS-SeqInd
                              (SEQ ID NO: 41)
TGGTCGTGGCGGTCGTGCGGTGGT
```

IV. Protocol Employing Sample Barcoded Reverse Gene Specific Primer

A. Design of Barcoded Reverse Gene Specific Primers.

```
                              (SEQ ID NO: 42, 43, and 84)
3'            L2       5'3'  L1
 RevGSP-ACCGACCAGCACCp GCCAGCACGCCA-(Barcode)-AGACA

Anchor 2        5'
CGACCAGCCACGAGCA-X-Bead

     A-TGGCTGGTCGTGG--CGGTCGTGCGGT-3'dT
                Link1s
```

Barcoded oligonucleotides with minimum structure linker 5'-Anchor 2-Barcode-Linker L1-3' are ligated to reverse gene specific primer set (RevGSP) with minimum structure 5'-phosphate-Linker L2-RevGSP-3' using complementary to linker L1 and linker L2 oligonucleotide Link1s and DNA ligase under ligation conditions.

The DNA ligation reaction attaches barcoded anchor oligonucleotides to reverse gene specific primers. As a result of the ligation reaction, the set of reverse gene specific primers is labeled with specific barcode. The set of barcoded reverse gene specific primers is purified from non-ligated products and used in the disclosed primer extension assay. The same set of gene specific primers could be labeled with plurality of different barcodes using the same protocol. In another embodiment, the same protocol could be used for barcoding set of forward gene specific primers.

Barcode-Anchor oligonucleotides are attached to the solid surface (e.g. beads) through linker X (e.g. X could be a cleavable linker). Furthermore, the different binding moiety (e.g. antibodies) may be attached to the beads to provide binding of the antibody-bead-barcoded GSP complex to specific cell types through antigen-antibody interactions.

Importantly, each barcode could have a complex structure as described in the application in more detail. These complex composite barcodes could have several domains, including but not limited to:

1) Sample barcode—specific sequence (usually from 8-14 nt) attached to a set of gene-specific primers, to label all extension products derived from target RNA sample.
2) UMI—complex random, semi-random (usually 8-12 nt), or set of unique specific sequences which allow to label each molecule used in disclosed primer extension assay with unique sequence/barcode. UMI could be added to RevGSP-Linker 2 set between RevGSP and linker L2.

3) Bead barcode—specific sequence (10-16 nt) unique for each bead if gene-specific primers are attached to the beads. In some embodiments, e.g. for single cell analysis applications (e.g. if only one biological sample used in the assay) bead barcode could be sample barcode.

4) Antibody barcode—specific sequence unique for each specific antibody immobilized to the beads.

Linker L1, linker L2 and complementary Link1s could be designed with variety of different sequences with minimum length of 4 nt each.

Examples of Anchor2-Barcode-Linker 1 Oligonucleotides Used in Ligation Reaction:

Barcodes are underlined

```
Anc2-BC1-L1
                                    (SEQ ID NO: 44)
ACGAGCACCGACCAGCACAGAGAACAAACACCGCACGACCG

Anc2-BC2-L1
                                    (SEQ ID NO: 45)
ACGAGCACCGACCAGCACAGAGGCGAAACACCGCACGACCG

Anc2-BC3-L1
                                    (SEQ ID NO: 46)
ACGAGCACCGACCAGCACAGAGCAAAAGGACCGCACGACCG
```

Example of Bead-Barcoded Oligonucleotide Conjugates (Synthesized by Chemgenes, Inc.) Used in Ligation Reaction.

In the diagram below: T25—is oligo dT (25 nt) moiety used for binding to the beads and purification of hybridization complexes between target RNA and barcoded reverse gene specific primers; PClinker—photocleavable linker, or SSlinker—bisulfite linker cleaved by sulfite ions (e.g. DTT treatment) used for detachment of reverse barcoded gene specific primers from the beads; Anchor2—binding site for universal amplification primer; UMI—Unique molecular index; Barcode—sample-specific 6 nt barcode (underlined); Linker L2-sequence necessary for ligation of barcodes with gene specific primer set.

```
ChemB-T25-PC1-Anc2-BC-L2
                                              (SEQ ID NO: 48)
                                        Anchor 2   UMI
Bead-linker-T25-PClinker-AGCACCGACCAGCACAGAVVNVVNV

 Barcode Linker L2
VCATCAGACCGCACGACCG-3'

ChemB-T25-SS-Anc2-BC-L2
                                              (SEQ ID NO: 50)
                                        Anchor 2   UMI
Bead-linker-T25-SSlinker-AGCACCGACCAGCACAGAVVNVVNV

 Barcode Linker L2
VCAGCATGACCGCACGACCG-3'
```

Example of Final Barcoded Reverse Gene Specific Primer Structure Employed in the Assay

```
                                    (SEQ ID NO: 51)
3'          L2-L1
RevGSP-ACCGACCAGCACCGCCAGGACGCCA-(Barcode)-

  Anchor2           5'
AGACACGACCAGCCACGAGGA
```

wherein, L2-L1 linker sequence generated by ligation of L1 and L2 linkers, Barcode—complex barcode, as described in a more details above, Anchor2—universal primer binding site. A similar structure could be generated for barcoded forward gene specific primer set and employed in the disclosed assay:

```
                                          (SEQ ID NO: 52)
3'          L2-L1
FwdGSP-ACCGACCAGCACCGCCAGGACGCCA-(Barcode)-ACAG

Anchor1          5'
ACGACCAGCCACGACGA
```

In some embodiments, the barcoded reverse gene specific primer composition could be synthesized by combinatorial (pool and split) chemical synthesis without DNA ligation step. In this embodiment, L2-L1 linker will be missing in the final structure.

B. High-throughput Synthetic Template and Calibration Control Template Oligonucleotide Synthesis Oligonucleotide libraries consisting of complex mixtures of oligonucleotides ranging in length from 150-250 base pairs were manufactured by Agilent Technologies under contract. Oligonucleotide design comprises full-length (or truncated in the middle) sequences of all amplicons flanked by gene specific primers, surrounding amplicon RNA sequences (for amplicons shorter than 200 bp) and two-point mutations downstream (4 nt) from the 3'-end of the each forward and reverse primer. In some embodiments, the oligonucleotides comprise the sequence of T7 promoter upstream of the forward primer binding site in order to generate sense synthetic template RNA that mimic natural target RNAs surrounding amplicon domains. Oligonucleotides were synthesized in spatially distinct locations using standard phosphoramidite chemistry on a silylated 6.625×6 inch wafer using an automated tool designed by Agilent Technologies. The solid support used in synthesis was a flat, non-porous silane coated glass rather than a locally curved, porous surface traditionally used. The coupling steps used inkjet-printing technologies to deliver the appropriate amount of activator and phosphoramidite monomer to specific spatial locations on the solid support under anhydrous conditions. Oxidation and detritylation reactions were performed in dedicated flowcells using novel mechanical operations and fluid management steps to eliminate the depurination side reaction limiting synthesis of long oligonucleotides. After deprotection and release, oligonucleotides were recovered and concentrated by lyophilization in 2 mL tubes. Each Oligo Library yields 10 pmol of nucleic acid material equally divided among up to 55,000 user-defined, unique sequences. In another embodiment, the synthetic templates were synthesized using conventional phosphoramidate chemistry and mixed together at approximately equal concentration by IDT and MWG-Operon companies.

C. Calibration Control RNA Template Synthesis by Gene Assembly

The calibration control genes which mimic natural genes were synthesized by GeneScript Technologies using modified Gibson gene assembly protocol. In one embodiment, the calibration control genes comprising T7 promoter, full-length target mRNA sequences including amplicon domain with at least 1-2 point mutation downstream of primer binding site, and polyA (approximately 50 nt) were synthesized and cloned in the GeneScript vector, and clones were validated by Sanger sequencing. To generate a set of calibration control templates, plasmid DNA clones corresponding to the set of control genes were mixed together (or used separately), digested by NotI restriction enzyme at a site located downstream of polyA site. Furthermore, the linearized plasmids were used as templates for RNA synthesis using T7 RNA polymerase and the manufacturer's protocol (MonsterScript kit, Epicentre Technologies).

D. High-throughput Gene Specific Primer Validation

Multiplex PCR primers with cognate target sequences were screened en masse. In some embodiments, the set of barcoded reverse gene specific primers (with the structure shown above) was first hybridized to control natural or synthetic template RNAs. Furthermore, the hybrids between target mRNA and barcoded reverse gene specific hybrids were combined together, purified and used as mix in the follow-up primer extension and amplification steps. In preferred embodiments, the hybridization step was performed with RNA sample and barcoded reverse gene specific primers in solution (e.g. primers released from beads). As discussed in a more detail above, the selection of primers with high hybridization efficiency and stability of target mRNA-primer complexes is the critical step which defines the overall performance of the assay and cross-talk between different samples. Moreover, using the barcoded reverse primers in the first step of protocol allows all samples to be combined together and therefore allows scale-up of the assay for analysis of hundreds-thousands of samples in single test tube format.

In another embodiment, the natural or synthetic template RNAs are reverse transcribed e.g., from random primer and synthesized cDNAs used as templates for the extension step, using barcoded forward gene specific primers and follow-up amplification steps.

In both protocols, uniformity of amplification, including primer efficiency, primer specificity and dynamic range (minimum 100-fold) were determined from multiplex reaction kinetic data. In order to reliably measure expression of different genes, the panel of 15 different human universal RNA from different commercial sources (Agilent, Clontech, BioChain, Qiagen, etc.) and synthetic template RNA were used as templates for cDNA synthesis. Non-specific primer activities were measured by yield of non-targeted products from human universal RNAs and negative control templates (human genomic DNA and mouse universal RNAs). The protocol for testing primer performance was repeated several times with sets of 3-5 PCR primer pairs per gene until the primers with high specific and low non-specific activity were selected. Finally, functionally validated primers were selected as experimentally validated primers for use in sets of experimental validated gene specific primers.

E. Multiplex RT-PCR Assay

1. Design of Primers for Anchor Addition, First and Second PCR Steps

Design of Barcoded Forward and Barcoded Reverse gene specific primers with anchor1 (Fwd-anchor1-GSP primers) and anchor2 (Rev-anchor2-GSP primers) with 3'-extended suppression portions for primer extension steps and universal PCR primers (F-MP1GAC and R-MP2CAG) to amplify anchored cDNA fragments by PCR.

Sequences that are underlined are the common PCR suppression portions, and those in italics and bold are unique sequences for forward or reverse primers, respectively. GSP is the gene-specific primer domain. The BC-Link is Barcode-Linker domain, which comprises the composite barcode as described in more details above and could be present in only reverse (preferred embodiment), only in forward or in both reverse and forward primers (SEQ ID NOS: 53 to 56).

```
F-MP1GAC
AGCAGCACCGACCAGCAGAC
   AGCACCGACCAGCAGACA(BC-Link)FwdGSP>

    Fwd-Anc1-GSP                      cDNA          Rev-Anc2-GSP
                                         <RevGSP(Link-BC)AGACACGACCAGCCACGA
                                                        GACACGACCAGCCACGAGCA
                                                               R-MP2CAG
```

For simplicity, the structures below show the design of primers and amplification products only for the preferred embodiment of using barcoded reverse and non-barcoded forward gene specific primer set:

```
                                              (SEQ ID NOS: 57 to 60)
          F-MP1GAC
      AGCAGCACCGACCAGCAGAC
         AGCACCGACCAGCAGACA-FwdGSP>

           Fwd-Anc1-GSP           cDNA          Rev-Anc2-GSP
                                     <RevGSP(BC-Link)AGACACGACCAGCCACGA
                                                     GACACGACCAGCCACGAGCA
                                                                 R-MP2CAG
```

The resultant structure of amplified cDNA products after the two sequential primer extension steps using Barcoded Rev-anchor2-GSPs and Fwd-anchor1-GSPs and a first PCR step using universal F-MP1GAC and R-MP2CAG primers is shown below:

```
                                  (SEQ ID NO: 61 and 62)
                                        (60-250 nt)
AGCAGCACCGACCAGCAGACA-FwdGSP-cDNA-RevGSP-Link-BC-

TCTGTGCTGGTCGGTGCTCGT

TCGTCGTGGCTGGTCGTCTGT-FwdGSP-cDNA-RevGSP-Link-BC-

AGACACGACCAGCCACGAGCA
```

The first PCR amplified cDNA products were then subjected to a second round of PCR to add Illumina P7, P5 sequencing adaptors. PCR primers for the second PCR step comprise anchor 1 and anchor 2 binding domains, indexing (highlighted in red) domains (optional domains, can be used if experiment requires to combine the different samples together for NGS step) and P5 or P7 sequences necessary for cluster formation in Illumina NGS instrument, as illustrated below:

Set of Forward Indexing Primers for $2^{nd}$ PCR step:

(SEQ ID NOS: 63-68)

FP7-A1Ind-A
AGCAGAAGACGGCATACGAGATATACGACAGCAGCAGCACCGACCAGCAG
ACA

FP7-A1Ind-B
AGCAGAAGACGGCATACGAGATACTGATGAGCAGCAGCACCGACCAGCAG
ACA

FP7-A1Ind-C
AGCAGAAGACGGCATACGAGATAGCATCAAGCAGCAGCACCGACCAGCAG
ACA

FP7-A1Ind-D
AGCAGAAGACGGCATACGAGATAAGTCGTAGCAGCAGCACCGACCAGCAG
ACA

FP7-A1Ind-E
AGCAGAAGACGGCATACGAGATATCGCATAGCAGCAGCACCGACCAGCAG
ACA

FP7-A1Ind-F
AGCAGAAGACCGCATACGAGATACATAGCAGCAGCAGCACCGACCAGCAG
ACA

Set of Reverse Indexing Primers for $2^{nd}$ PCR step:

(SEQ ID NOS: 69-74)

RP5-A2Ind-A
ACGGCGACCACCGAGATCTACACATACGACACGACGAGCACCGACCAGCA
CAGA

RP5-A2Ind-B
ACGGCGACCACCGAGATCTACACACTGATGACGACGAGCACCGACCAGCA
CAGA

RP5-A2Ind-C
ACGGCGACCACCGAGATCTACACAGCATCAACGACGAGCACCGACCAGCA
CAGA

RP5-A2Ind-D
ACGGCGACCACCGAGATCTACACAAGTCGTACGACGAGCACCGACCAGCA
CAGA

RP5-A2Ind-E
ACGGCGACCACCGAGATCTACACATCGCATACGACGAGCACCGACCAGCA
CAGA

RP5-A2Ind-F
ACGGCGACCACCGAGATCTACACACATAGCACGACGAGCACCGACCAGCA
CAGA

Set of Forward and Reverse Non-indexing Primers for $2^{nd}$ PCR step:

(SEQ ID NOS: 75-76)

Fp7-A1
AGCAGAAGACGGCATACGAGATAGCAGCAGCACCGACCAGCAGACA

RP5-A2
ACGGCGACCACCGAGATCTACACACGACGAGCACCGACCAGCACAGA

After a second PCR step with Forward and Reverse indexing primers the final amplicon structure, flanked with P7 and P5 Illumina's adaptor sequences and ready for NGS, is shown below:

(SEQ ID NOS: 77-78)

P7(Ind)*AGC*AGCACCGACCAGCA*GACA*-FwdGSP-cDNA-RevGSP
(LinkBC)TCTGTGCTGGTCGGTGCTCGT(Ind)P5

P7(Ind)TCGTCGTGGCTGGTCGTCTGT-FwdGSP-cDNA-RevGSP
(LinkBC)AGACACGACCAGCCACGAGCA(Ind)P5

The sequences of primers for NGS sequencing (e.g. Illumina NextSeq500 platform) of cDNA inserts, barcode domain and indexes are provided below:

SeqDRAlink-Rev
(SEQ ID NO: 79)
TGGCGTGCTGGCGGTGCTGGTCGGT

SeqDNA-Fwd
(SEQ ID NO: 80)
AGCAGCAGCACCGACCAGCAGACA

SeqBarcode-Fwd
(SEQ ID NO: 81)
ACCGACCAGCACCGCCAGCACGCCA

Optional sequencing primers:

SeqIND-Fwd
(SEQ ID NO: 82)
TCTGTGCTGGTCGGTGCTCGTCGT

SeqIND-Rev
(SEQ ID NO: 82)
TGTCTGCTGGTCGGTGCTGCTGCT

SeqDNA-Rev
(SEQ ID NO: 83)
ACGACGAGCACCGACCAGCACAGA

An example protocol for NGS sequencing of amplified cDNA products in Next Seq500 machine using 150-nt sequencing kit is shown below:

Read 1: SeqDNAlink-Rev>81 cycles
Ind 1: SeqIND-Rev>6 cycles
Ind 2: SeqBarcode-Fwd>38 cycles
Read 2: SeqDNA-Fwd>35 cycles The read number for SeqBarcode-Fwd primer could depend on the design of the specific barcode domain cassette. The read cycle number 38 was selected for reading complex sample barcode domain with the structure: Antibody barcode(6)-Sample barcode(6)-Bead barcode(14)-UMI(12).

F. Protocol for Multiplex RT-PCR amplification of target genes for expression profiling or mutation analysis starting from total RNA (1 ng-50 ng) mixed with calibration control RNA templates and using barcoded forward gene specific primer set.

Step 1. Total RNAs (mixed with synthetic calibration control RNA templates in a separate wells) was converted to cDNA in 10-μl of reaction mix using random primer (N6, 5 uM), 1×GC buffer, dNTP (500 uM) and Maxima Reverse Transcriptase (10 units, Thermo-Fisher) at $50^{4}$C for 30 min.

Step 2. cDNA was primed (adding universal anchors 1 and barcodes) using a mix of Barcoded Forward-anchor1-GSP primers (5 nM final concentration for each primer) in 20-ul reaction mix comprising 1×GC buffer, dNTP (250 uM) and Phusion II (4 units, Thermo-Fisher) for 1 cycles at (98° C. for 1 min, 64° C. for 30 min).

Step 3. Barcoded cDNA products after first primer extension step were combined together and purified using an equal volume of AMPure magnetic beads (Beckman-Coulter) using manufacturer's protocol. Eluted cDNA (20 ul) was treated with exonuclease I (20 units, New England BioLabs) at 37° C. for 30-min.

Step 4. The Barcoded DNA products generated in step 3, were further extended (add universal anchor 2) using mix of Reverse-ancho2-GSPs in 25-ul reaction mix comprising 1×GC buffer, dNTP (250 uM) and Phusion II (5 units, Thermo-Fisher) for 1 cycles at (98° C. for 1 min, 64° C. for 30 min) and treated with exonuclease I (20 units) at 37° C. for 30-min.

Step 5. 1st PCR step. Whole volume (25-µl) of barcoded anchored cDNA fragments (from Step 4) were amplified in 75-µl reaction mix comprising 1×HF Buffer, dNTP (200 uM), universal PCR primers F-MP1GAC and R-MP2CAG and Phusion II (15 units, Thermo-Fisher) for 8-20 cycles (50 ng-1 ug of starting RNA, respectively) at (98° C. for 10 sec, 72° C. for 20 sec).

Step 6. 2nd PCR step. 5-pi aliquot of 1st PCR was amplified in 100-µl of PCR mix comprising 1×HF Buffer, dNTP (200 µM), indexed (specific for the each of several samples) or non-indexed (only for one sample) forward and reverse PCR primers and Phusion II (20 units, Thermo-Fisher) for 7 cycles at (98° C. for 10 sec, 72° C. for 20 sec).

Step 7. The amplified PCR products were analyzed in 3.5% agarose-1×TAE gel to optimize the cycle number and finally digested with exonuclease I (20 units, New England Biolabs), incubated and 37° C. for 30 min, inactivated at 65° C. for 15 min and purified by Qia PCR column. Purified PCR products were quantitated by Qubit (Thermo-Fisher) and if necessary different samples were mixed together (at an equal amount), diluted to 10 nM and sequenced in NextSeq500 using Illumina paired-end protocol and reagents for 150 cycles.

G. Protocol for Multiplex RT-PCR Amplification of Target Genes for Expression Profiling or Mutation Analysis in Single Cells Using Barcoded Reverse Gene Specific Primer Set.

Step 1. Individual cells (5,000-10,000) were deposited by FACS in a separate wells (or as a separate droplets in oil) or partitioned in microdroplets using a microfluidics instrument (MissionBio) together with the barcoded reverse gene specific primer set immobilized on beads through photo-cleavable linkers (ChemB-T25-PCI-Anc2-BC-L2, ChemGenes, see structure above) in 1×TCL lysis-hybridization buffer (Qiagen) together with calibration control RNA template set.

Step 2. Barcoded reverse gene specific primers were released from beads by UV365 nm treatment (20 watts) for 5 minutes and hybridized with target RNA templates (present in lysates in a separate compartments) at 60° C. for 30 min. The hybridized complexes between the target RNA and the barcoded reverse gene specific primers were combined together (after removal of the oil phase for microdroplets) and purified bound to oligo dT25-beads by washing the beads three times in 1×SSC buffer. The purified target RNA-Barcoded reverse gene specific primer complexes were treated with thermosensitive exonuclease I (20 units, New England BioLabs) in 20-µl of 1×GC buffer at 37° C. for 30-min, 50° C. for 5 min. In an alternative protocol, the hybridized complexes between the target RNA and the barcoded reverse gene specific primers were combined together (after removal of the oil phase for microdroplets), purified using RNA/DNA micro kit (Qiagen) and treated with thermosensitive exonuclease I.

Step 3. Reverse primer extension step. RNA was converted to cDNA from barcoded reverse gene specific primers (hybridized to target RNA in Step 2) in 40-µl of reaction mix comprising 1×GC buffer, dNTP (500 uM), ThermaStop-RT (80 units, ThermaGenix) and Maxima Reverse Transcriptase (400 units, Thermo-Fisher) at 55° C. for 30 min.

Step 4. Forward primer extension step. Barcoded cDNA (generated in Step 3) was primed using a mix of Forward-anchor1-GSP primers (5 nM final concentration for the each primer) in 50-ul reaction mix comprising 1×GC buffer, dNTP (250 uM) and Phusion II (10 units, Thermo-Fisher) for 1 cycles at (98° C. for 1 min, 64° C. for 30 min) and treated with exonuclease I (20 units) at 37° C. for 30-min.

Step 5. 1st PCR step. The whole volume (50-µl) of barcoded anchored cDNA fragments (from Step 4) was amplified in 100-µl reaction mix comprising 1×HF Buffer, dNTP (200 uM), universal PCR primers F-MP1GAC and R-MP2CAG and Phusion II (20 units, Thermo-Fisher) for 14 cycles at (98° C. for 10 sec, 72° C. for 20 sec).

Step 6. 2nd PCR step. A 5-µl aliquot of 1st PCR was amplified in 100-µl of PCR mix comprising 1×HF Buffer, dNTP (200 µM), indexed (specific for the each of several samples) or non-indexed (only for one sample) Fwd and Rev PCR primers and Phusion II (20 units, Thermo-Fisher) for 7 cycles at (98° C. for 10 sec, 72° C. for 20 sec).

Step 7. The amplified PCR products were analyzed in 3.5% agarose-1×TAE gel to optimize the cycle number and finally digested with exonuclease I (20 units, New England Biolabs), incubated and 37° C. for 30 min, inactivated at 65° C. for 15 min and purified by AMPure beads (1.5× volume) using manufacturer's protocol (Beckman-Coulter). Purified PCR products were quantitated by Qubit (Thermo-Fisher) and if necessary different samples were mixed together (at equal amount), diluted to 10 nM and sequenced in NextSeq500 using Illumina paired-end protocol and reagents for 150 cycles.

H. Next Generation Sequencing Applications

Recently developed targeted approaches reduce NGS data complexity and generate qualitative sequencing information by measurement of a subset of targets per technical replicate with minimal sample usage. Nonetheless, targeted approaches reported thus far have limited clinical utility due to several scientific challenges, such as a priori determining which genetic markers have the most clinical significance and identifying key genetic variants that are correlated with a specific drug response. Furthermore, technical limitations due to skewed or inaccurate quantitative representation of clinical targets and inter-library variation confound their utility in the clinical setting.

For example, cancer is a complex multigenic disease characterized by diverse genetic and epigenetic alterations. A comprehensive catalog of all types of variants in cancer opens novel and unique opportunities for understanding the mechanism of cancer onset or progression and facilitates a more personalized approach to clinical care, including improved risk stratification and treatment selection. Next-generation sequencing (NGS) is now a major driver in translational and genetic research, providing a powerful way to study DNA or RNA from clinical specimens. For example, transcriptome profiling can unambiguously define a unique gene expression signature for each tumor that may prove useful for both disease classification and prognosis. Unfortunately, both the cost and the complexity of whole genome DNA sequencing or transcriptome RNA-sequencing data sets impede the use of these methodologies in routine molecular diagnostic testing.

Predesigned targeted gene panels disclosed in the current invention contain essential genes associated with human disease or phenotype(s), selected from publications, open access databases/resources, and expert curation. By focusing on the genes most likely to be involved in cellular processes and disease, these targeted RNA-Seq panels conserve sequencing next-generation sequencing (NGS) resources and minimize data analysis considerations. Predesigned panels will be unique experimental tools for clinical research on various diseases, such as cancer, signaling pathways, markers of cell lineage, differentiation, and activation. Examples below illustrate several assays we developed for clinical research applications.

1. Cell Marker Panel Assay for Profiling Cell Composition

The human Cell Marker Assay is a targeted multiplex RT-PCR panel that enables gene signature-based inference and quantitative evaluation of multiple unique immune and stromal cell types. The Cell Marker Assay provides a cost-effective strategy for quantitative analysis of cell composition in a wide range of clinical samples based on analysis of all well-characterized cell specific biomarkers.

The cell marker gene sets summarize and characterize gene signatures for 64 distinct cell types, spanning multiple adaptive and innate immunity cells, hematopoietic progenitors, epithelial cells, and extracellular matrix cells derived from thousands of published gene expression signatures. To generate our compendium of gene-specific signatures for human cell types, we used data from ENCODE, FANTOM, ImmGen, and the Human Primary Cells Atlas (HPCA). Also, we collected gene expression profiles from the Blueprint project, from which we annotated 144 samples from 28 cell types, and the IRIS project, from which we annotated 95 samples from 13 cell types. We collected and curated gene expression profiles from ~2,310 samples of pure cell types and annotated 64 distinct cell types and cell subsets.

The Human Cell Marker 1.3K targeted panel measures the expression level of 1,285 human protein-coding genes by combining highly multiplexed RT-PCR amplification with the depth and precision of NGS quantitation. The Cell Marker 1.3K panel also includes a set of 85 housekeeping genes with constant expression between different cell types. The Cell Marker 1.3K panel employs computationally-predicted set of PCR primers for multiplex PCR which are functionally (i.e., experimentally) validated, e.g., as described above. The unique multiplex primer design minimizes primer dimerization and cross-reactivity while enhancing specificity of hybridization and efficacy in primer extension steps. The set of calibration control RNA templates was developed for all housekeeping and 1285 cell marker genes, and is mixed with sample template RNA to be used as internal standards for calibration and QC of all RNA samples employed in the assay. It is an easy-to-run, one-tube assay that can be run directly from cell extract or total RNA (10 pg-50 ng) isolated from cells, tissues, or blood. In this embodiment, the RNA template compositions from different samples are hybridized with set of barcoded reverse gene specific primers, the RNA-primer hybrids are combined together in single-test tube, purified from non-bind primers, and used for follow-up primer extension and amplification steps. The multiplex single-tube assay provides robust, quantitative, and reproducible measurements of each expressed gene in the set of biological samples over as much as 5-orders of magnitude differences in expression level.

In another embodiment, the reverse gene specific primer set is immobilized to barcoded beads (one specific barcode per bead) through a cleavable linker. The barcoded bead-gene specific primer conjugates are mixed with the set of individual cells from a cell sample together with calibration control RNAs. One bead-one cell compositions are then isolated in separate compartments by FACS, aliquoting or microdroplet technology. The hybridization of detached barcoded gene specific primers with target mRNAs in solution, combining of all samples together, extension of purified of RNA-gene specific primer hybrids and follow up RT-PCR-NGS protocol allows a high level of multiplexing in analysis of thousands of individual cells. Moreover, single cell analysis combined with calibration control templates allows quality control analysis of each individual cell, plus normalization and calibration of the single cell data.

As to utility, the generated normalized quantitative single cell data could be used to accurately profile the specific cell composition in a wide range of clinical samples, including blood, tissue, biological fluids, organoids, isolated cells, organs, etc. in normal, treated, and disease states. The comprehensive set of cell type specific markers included in the assay allows robust and cost-effective cell typing analysis even at the scale of hundreds of thousands of individual cells. Moreover, Cell Marker 1.3K assay provides a cost-effective strategy for the discovery of novel diagnostic and prognostic cell types and cell specific biomarkers in xenograft, fine needle aspirate (FNA), biopsy, blood, and circulating tumor cell (CTC) clinical samples. Currently, an extended panel of cell markers based on the most recent public data are in development to address specific disease areas.

2. Blood Biomarker Diagnostic Panel

There is ample evidence that development of novel prognostic and predictive biomarkers is a critical step for selecting patients predisposed to respond to existing and novel (e.g. immunotherapy) treatments and their combinations. The Blood Biomarker 10K assay (BB10K) allows one to dissect immunological response mechanisms and discover novel prognostic and predictive immune response gene signatures.

The BB10K assay was developed to quantitatively profile expression of 10,000 key immunity genes expressed in different types of blood cells, using, in the preferred embodiment, single-cell multiplex RT-PCR amplification from total RNA followed by NGS sequencing. The individual cells (10K-100K) from peripheral blood mononuclear cell (PBMC) samples were mixed with cell type-specific antibody-bead-barcoded reverse gene specific primer conjugate and sorted by FACS or microfluidic technologies in separate droplets (compartments) for cell-specific barcoding of target mRNAs directly in cell lysates. Furthermore, each specific bead-antibody conjugate could be optically encoded to facilitate isolation and analysis e.g. by FACS specific single cell-bead conjugates. No mRNA enrichment, beta-globin depletion, or other processing are required. Up to 100 PBMC clinical samples could be run and combined together in the assay to provide a high level of multiplexing and significantly reduce sample-to-sample variation and batch effect issues. Furthermore, the built-in internal calibration standards allow calibration and adjusting of digital HT sequencing data depending on the level of intrinsic noise and quality of samples. The BB10K assay provides quantitative expression data of immune-related genes with 1,000-fold dynamic range and sensitivity down to 10 copies of RNA per cell in whole cell lysate or cell fractions (e.g. nucleus) from frozen PBMC clinical samples. Up to 100 PBMC clinical samples could be run and combined together (after hybridization step) in the assay to provide high level of multiplexing and significantly reduce sample-to-sample variation and batch effect issues.

The BB10K panel includes more than 100 experimentally validated core gene signatures (e.g., based on immunity HallMark database, Broad Institute) which correlate with a wide range of pathological conditions (cancer, cardiovascular, infection, acute pain, etc.), and predict efficacy of immunotherapy in several cancer types, including melanoma, colorectal, breast, and lung cancers after stimulation in vitro or in vivo by drugs, physical treatment, biologics or chemical compounds (heat shock, LPS, bacterial antigens, etc.). Furthermore, the core signatures were expanded by developing a computational functional interaction network model to predict key nodes in pathways specific for antigen presentation and recognition, inhibition and activation of immune cells. The BB10K panel also includes a set of TCR and BCR genes (variable regions) and housekeeping genes with constant expression between different blood cell types. The set of calibration control RNA templates was developed for all housekeeping and 1000 different blood cell type-specific genes in order to use as internal standards for calibration and QC of all cells employed in the assay.

Single cell expression profiling in all main blood cell types with the BB10K gene panel enables researchers to discover prognostic and predictive immune response biomarker signatures. The predictive signatures have the potential to stratify patients with a wide range of clinical indications for responses to the growing number of therapeutic treatments.

Notwithstanding the appended claims, the disclosure is also defined by the following clauses:

1. A method of preparing a plurality of sample-barcoded anchor-domain-flanked gene specific deoxyribonucleic acid (DNA) fragments from a template ribonucleic acid (RNA) sample, the method comprising:
   - employing a set of gene specific primer (GSP) pairs to produce the plurality of sample-barcoded anchor-domain-flanked gene specific DNA fragments from the template RNA sample, wherein each pair of gene specific primers (GSPs) is made up of an anchor domain comprising forward primer and an anchor domain comprising reverse primer, at least one of which comprises a sample barcode domain.

2. The method according to Clause 1, wherein each pair of the set of GSPs is made up of a forward primer comprising an anchor domain and a reverse primer comprising an anchor domain and a sample barcode domain.

3. The method according to Clause 2, wherein the method comprises contacting the template RNA sample with the reverse primers of the set to produce a hybrid composition comprising RNA/anchored sample barcoded reverse primer hybrids.

4. The method according to Clause 2, wherein the reverse primers are linked to a solid support.

5. The method according to Clause 4, wherein the solid support is a bead.

6. The method according to Clauses 4 and 5, wherein the reverse primers are linked to the solid support by a cleavable linker.

7. The method according to any of Clauses 3 to 6, wherein the method comprises removing unbound reverse primers from the hybrid composition to produce a hybrid enriched composition.

8. The method according to Clause 7, wherein the method comprises contacting the hybrid enriched composition with the forward primers of the set under primer extension reaction conditions to produce the plurality of sample-barcoded anchor-domain-flanked gene specific DNA fragments from the template RNA.

9. The method according to Clause 1, wherein the method comprises employing a sample-barcoded donor nucleic acid comprising an anchor domain and a sample barcode domain to produce the set of GSPs.

10. The method according to Clause 9, wherein the sample-barcoded donor nucleic acid comprises an RNA capture domain.

11. The method according to Clause 10, wherein the sample-barcoded donor nucleic acid further comprises a first linker, either the forward primers or the reverse primers comprise a second linker and the method further comprises ligating the first and second linkers.

12. The method according to any of Clauses 9 to 11, wherein the sample-barcoded donor nucleic acid comprises the structure: 3'-linker 1-sample barcode domain-anchor 2 domain-RNA binding domain-5'.

13. The method according to Clause 12, wherein the reverse primers comprise the structure: 3'-reverse GSP domain-linker 2-5'; and the forward primers comprise the structure 5'-anchor 1-forward GSP domain-3'.

14. The method according to Clause 13, wherein the method comprises:
   - contacting the template RNA sample with the sample-barcoded donor nucleic acid and the reverse primers under hybridization conditions;
   - ligating the linker 1 and linker 2 domains of hybrid sample-barcoded donor nucleic acid and reverse primers to produce sample-barcoded reverse primers;
   - reverse transcribing first strand complementary DNA (cDNA) molecules from the sample-barcoded reverse primers; and
   - contacting the first strand cDNA molecules with the forward primers under polymerase mediated primer extension reaction conditions to produce the plurality of sample-barcoded anchor-domain-flanked gene specific DNA fragments from the RNA sample.

15. The method according to any of Clauses 9 to 11, wherein the sample-barcoded donor nucleic acid comprises the structure: 3'-RNA binding domain-anchor 1 domain-sample barcode domain-linker 1 domain-5'.

16. The method according to Clause 15, wherein the forward primers comprise the structure: 3'-forward GSP domain-linker 2-5'; and the reverse primers comprise the structure 5'-anchor 2-reverse GSP domain-3'.

17. The method according to Clause 16, wherein the method comprises:
   - contacting the template RNA sample with the sample-barcoded donor nucleic acid under conditions sufficient to reverse transcribe first strand cDNA molecules from the template RNA sample;
   - contacting the first strand cDNA molecules with the forward primers under polymerase mediated primer extension reaction conditions sufficient to produce second strand cDNA molecules comprising a 5' linker 2 domain and a 3' linker 1 domain;
   - ligating the 5' linker 1 domain to the 3' linker 2 domain to circularize the second strand cDNA molecules; and
   - contacting the circularized second strand cDNA molecules with the reverse primers to produce the plurality of sample-barcoded anchor-domain-flanked gene specific DNA fragments from the template RNA sample.

18. The method according to any of the preceding clauses, wherein the forward and reverse primers of each primer pair comprise gene specific (GSP) domains that are experimentally validated as suitable for use in a multiplex amplification assay.

19. The method according to any of the preceding clauses, wherein the forward and reverse primers of each primer pair are separated by a template distance of 60 to 300 nt.

20. The method according to any of the preceding clauses, wherein the template ribonucleic acid sample comprises messenger ribonucleic acids (mRNAs).

21. The method according to any of the preceding clauses, wherein the template RNA sample is obtained from a single cell.
22. The method according to Clause 21, wherein the method comprises obtaining the template RNA sample by isolating the single cell and then lysing the isolated single cell to produce the RNA sample.
23. The method according any of the preceding clauses, wherein the GSP domain of each forward primer ranges in length from 18 to 25 nt.
24. The method according any of the preceding clauses, wherein the GSP domain of each reverse primer ranges in length from 30 to 70 nt.
25. The method according to any of the preceding clauses, wherein the flanking anchor domains comprise a universal priming site and the method further comprises amplifying the primer extension products comprising the anchor domains with universal forward and reverse primers having sequences complementary to the universal priming sites under amplification conditions sufficient to produce a barcoded amplicon composition comprising multiple product amplicons.
26. The method according to Clause 25, wherein the universal forward and reverse primers further comprise Next-Generation Sequencing (NGS) adaptor domains.
27. The method according to Clause 26, wherein the method further comprises adding NGS adaptor domains to the multiple product amplicons of the barcoded amplicon composition
28. The method according Clause 27, wherein the NGS adaptor domains are added to the multiple product amplicons of the barcoded amplicon composition via an amplification protocol.
29. The method according to any of Clauses 25 to 28, wherein the method further comprises sequencing the multiple product amplicons.
30. The method according to Clause 29, wherein the multiple product amplicons are sequenced using an NGS protocol.
31. The method according to any of the preceding clauses, wherein the method is performed in a well.
32. The method according to any of Clauses 1 to 30, wherein the method is performed in a droplet.
33. The method according to Clause 32, wherein the droplet is produced using a microfluidics protocol.
34. The method according to Clause 32, wherein the droplet is producing using a fluorescence activated cell sorter (FACS) protocol.
35. The method according to any of the preceding clauses, wherein the method comprises a pooling step.
36. The method according to any of the preceding clauses, wherein the method comprises employing a calibration ribonucleic acid composition.
37. A method of preparing a plurality of sample-barcoded anchor-domain-flanked gene specific DNA fragments from a template RNA sample, the method comprising:
- contacting the template RNA sample with reverse primers of a set of GSPs, wherein the reverse primers comprise an anchor domain and a sample barcode domain, to produce a hybrid composition comprising RNA/anchored sample barcoded reverse primer hybrids;
- removing unbound reverse primers from the hybrid composition to produce a hybrid enriched composition;
- reverse transcribing the hybrid enriched composition to produce a cDNA composition; and
- contacting the cDNA composition with forward primers of the set, wherein the forward primers comprise an anchor domain, under primer extension reaction conditions to produce the plurality of sample-barcoded anchor-domain-flanked gene specific DNA fragments from the template RNA sample.

38. The method according to Clause 37, wherein the reverse primers further comprise a UMI domain.
39. The method according to Clause 37, wherein the reverse primers are linked to a solid support.
40. The method according to Clause 39, wherein the solid support is a bead.
41. The method according to Clauses 39 and 40, wherein the reverse primers are linked to the solid support by a cleavable linker.
42. The method according to Clause 41, wherein the method further comprises cleaving the cleavable linker.
43. The method according to any of Clauses 39 to 42, wherein the solid support further comprises specific binding pair member.
44. The method according to Clause 43, wherein the specific binding pair member specifically binds to a cell surface marker.
45. The method according to any of Clauses 39 to 44, wherein the reverse primers further comprise a solid support barcode domain.
46. The method according to any of Clauses 37 to 45, wherein the template RNA sample is obtained from a single cell.
47. The method according to Clause 46, wherein the method comprises obtaining the template RNA sample by isolating the single cell and then lysing the isolated single cell to produce the template RNA sample.
48. The method according to Clause 47, wherein the cell is isolated and lysed in a well.
49. The method according to Clause 47, wherein the cell is isolated and lysed in a droplet.
50. The method according to Clause 49, wherein the droplet is produced using a microfluidics protocol.
51. The method according to Clause 49, wherein the droplet is producing using a fluorescence activated cell sorter (FACS) protocol.
52. The method according to any of Clauses 37 to 51, wherein the method comprises a pooling step.
53. The method according to Clause 52, wherein the pooling step comprises pooling the enriched hybrid composition with at least one additional enriched hybrid composition produced form at least one additional template RNA sample.
54. The method according to any of Clauses 37 to 53, wherein the method comprises employing a calibration ribonucleic acid composition.
55. The method according to any of Clauses 37 to 54, wherein the method further comprises removing non-extended forward primers from the plurality of sample-barcoded anchor-domain-flanked gene specific DNA fragments.
56. The method according any of Clauses 37 to 55, wherein the GSP domain of each forward primer ranges in length from 18 to 25 nt.
57. The method according any of Clauses 37 to 56, wherein the GSP domain of each reverse primer ranges in length from 30 to 70 nt.
58. The method according to any of Clauses 37 to 57, wherein the flanking anchor domains comprise a universal priming site and the method further comprises amplifying the primer extension products comprising the anchor domains with universal forward and reverse primers having sequences complementary to the universal priming sites under amplification conditions sufficient to produce a barcoded amplicon composition comprising multiple product amplicons.

59. The method according to Clause 58, wherein the universal forward and reverse primers further comprise Next-Generation Sequencing (NGS) adaptor domains.

60. The method according to Clause 59, wherein the method further comprises adding NGS adaptor domains to the multiple product amplicons of the barcoded amplicon composition 61. The method according Clause 60, wherein the NGS adaptor domains are added to the multiple product amplicons of the barcoded amplicon composition via an amplification protocol.

62. The method according to any of Clauses 58 to 61, wherein the method further comprises sequencing the multiple product amplicons.

63. The method according to Clause 62, wherein the multiple product amplicons are sequenced using an NGS protocol.

64. A system comprising:

nucleic acid amplification device;

a sample-barcoded donor nucleic acid comprising a RNA binding domain, an anchor domain and a sample barcode domain; and a set of GSPs wherein each pair of GSPs is made up of a forward primer and a reverse primer.

65. The system according to Clause 64, wherein the sample-barcoded donor nucleic acid further comprises a first linker and either the forward primers or the reverse primers comprise a second linker.

66. The system according to Clause 65, wherein the sample-barcoded donor nucleic acid comprises the structure: 3'-linker 1-sample barcode domain-anchor 2 domain-RNA binding domain-5'.

67. The system according to Clause 66, wherein the reverse primers comprise the structure: 3'-reverse GSP domain-linker 2-5'; and the forward primers comprise the structure 5'-anchor 1-forward GSP domain-3'.

68. The system according to Clause 67, wherein the sample-barcoded donor nucleic acid comprises the structure: 3'-RNA binding domain-anchor 1 domain-sample barcode domain-linker 1 domain-5'.

69. The system according to Clause 68, wherein the forward primers comprise the structure: 3'-forward GSP domain-linker 2-5'; and the reverse primers comprise the structure 5'-anchor 2-reverse GSP domain-3'.

70. The system according to any of Clauses 64 to 69, wherein the forward and reverse primers of each primer pair comprise GSP domains that are experimentally validated as suitable for use in a multiplex amplification assay.

71. The system according to any of Clauses 64 to 70, wherein the forward and reverse primers are separated by a template distance of 60 to 300 nt.

72. The system according to any of Clauses 64 to 71, wherein the system further comprises a RNA sample.

73. The system according to Clause 72, wherein the RNA sample is from a single cell.

74. The system according to any of Clauses 64 to 73, wherein the device is a thermal cycler.

75. A system comprising:

nucleic acid amplification device; and a set of GSPs wherein each pair of GSPs is made up of a forward primer and a reverse primer comprising a sample barcode domain.

76. The system according to Clause 75, wherein the forward and reverse primers of each primer pair comprise GSP domains that are experimentally validated as suitable for use in a multiplex amplification assay.

77. The system according to any of Clauses 75 to 76, wherein the forward and reverse primers are separated by a template distance of 60 to 300 nt.

78. The system according to any of Clauses 75 to 77, wherein the reverse primers are linked to a solid support.

79. The system according to Clause 78, wherein the solid support is a bead.

80. The system according to any of Clauses 78 to 79, wherein the reverse primers are linked to the solid support by a cleavable linker.

81. The system according to any of Clauses 78 to 80, wherein the solid support further comprises specific binding pair member.

82. The system according to Clause 81, wherein the specific binding pair member specifically binds to a cell surface marker.

83. The system according to any of Clauses 78 to 82, wherein reverse primers further comprise a solid support barcode domain.

84. The system according to any of Clauses 75 to 83, wherein the system further comprises a RNA sample.

85. The system according to Clause 84, wherein the RNA sample is from a single cell.

86. The system according to any of Clauses 75 to 85, wherein the device is a thermal cycler.

In at least some of the previously described embodiments, one or more elements used in an embodiment can interchangeably be used in another embodiment unless such a replacement is not technically feasible. It will be appreciated by those skilled in the art that various other omissions, additions and modifications may be made to the methods and structures described above without departing from the scope of the claimed subject matter. All such modifications and changes are intended to fall within the scope of the subject matter, as defined by the appended claims.

It will be understood by those within the art that, in general, terms used herein, and especially in the appended claims (e.g., bodies of the appended claims) are generally intended as "open" terms (e.g., the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims may contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (e.g., "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (e.g., the bare recitation of "two recitations," without other modifiers, means at least two recitations, or two or more recitations). Furthermore, in those instances where a convention analogous to “at least one of A, B, and C, etc.” is used, in general such a construction is intended in the sense one having skill in the art would understand the convention (e.g., “a system having at least one of A, B, and C” would include but not be limited to systems that have A alone, B alone, C alone, A and B together, A and C together, B and C together, and/or A, B, and C together, etc.). In those instances where a convention analogous to “at least one of A, B, or C, etc.” is used, in general such a construction is intended in the sense one having skill in the art would understand the convention (e.g., “a system having at least one of A, B, or C” would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase “A or B” will be understood to include the possibilities of “A” or “B” or “A and B.”

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, such as in terms of providing a written description, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as “up to,” “at least,” “greater than,” “less than,” and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Accordingly, the preceding merely illustrates the principles of the invention. It will be appreciated that those skilled in the art will be able to devise various arrangements which, although not explicitly described or shown herein, embody the principles of the invention and are included within its spirit and scope. Furthermore, all examples and conditional language recited herein are principally intended to aid the reader in understanding the principles of the invention and the concepts contributed by the inventors to furthering the art, and are to be construed as being without limitation to such specifically recited examples and conditions. Moreover, all statements herein reciting principles, aspects, and embodiments of the invention as well as specific examples thereof, are intended to encompass both structural and functional equivalents thereof. Additionally, it is intended that such equivalents include both currently known equivalents and equivalents developed in the future, i.e., any elements developed that perform the same function, regardless of structure. Moreover, nothing disclosed herein is intended to be dedicated to the public regardless of whether such disclosure is explicitly recited in the claims.

The scope of the present invention, therefore, is not intended to be limited to the exemplary embodiments shown and described herein. Rather, the scope and spirit of present invention is embodied by the appended claims. In the claims, 35 U.S.C. § 112(f) or 35 U.S.C. § 112(6) is expressly defined as being invoked for a limitation in the claim only when the exact phrase “means for” or the exact phrase “step for” is recited at the beginning of such limitation in the claim; if such exact phrase is not used in a limitation in the claim, then 35 U.S.C. § 112 (f) or 35 U.S.C. § 112(6) is not invoked.

SEQUENCE LISTING (10640 sequences)

SEQ ID NO: 1 - DNA, 18 bp, synthetic construct
  source 1..18: mol_type = other DNA
agcaccgaccagcagaca

SEQ ID NO: 2 - DNA, 18 bp, synthetic construct
  source 1..18: mol_type = other DNA
agacacgaccagccacga

SEQ ID NO: 3 - DNA, 20 bp, synthetic construct
  source 1..20: mol_type = other DNA
aatgatacggcgaccaccga

SEQ ID NO: 4 - DNA, 24 bp, synthetic construct
  source 1..24: mol_type = other DNA
caagcagaagacggcatacgagat

SEQ ID NO: 5 - DNA, 33 bp, synthetic construct
  source 1..33: mol_type = other DNA
acactctttccctacacgacgctcttccgatct

SEQ ID NO: 6 - DNA, 34 bp, synthetic construct
  source 1..34: mol_type = other DNA
gtgactggagttcagacgtgtgctcttccgatct

SEQ ID NO: 7 - DNA, 30 bp, synthetic construct
  source 1..30: mol_type = other DNA
ccatctcatccctgcgtgtctccgactcag

SEQ ID NO: 8 - DNA, 23 bp, synthetic construct
  source 1..23: mol_type = other DNA
cctctctatgggcagtcggtgat

SEQ ID NO: 9 - DNA, 16 bp, synthetic construct
  source 1..16: mol_type = other DNA
ccacgaccagccacga

SEQ ID NO: 10 - DNA, 33 bp, synthetic construct
  misc_feature 1: note = The nucleotide at position 1 is attached to (NVT30)-Bead.
  misc_feature 18..19: note = A UMI and BC domain are present between the nucleotides at positions 18 and 19.
  source 1..33: mol_type = other DNA
agcaccgaccagcacagaaccaccgcacgaccg

SEQ ID NO: 11 - DNA, 87 bp, synthetic construct
  variation 32: note = n is a, c, g, or t
  variation 53: note = n is a, c, g, or t
  variation 56: note = n is a, c, g, or t
  source 1..87: mol_type = other DNA
ttttttttttttttttttttttttttttttvnagcaccgaccagcacagavvnvvnvvgcccaggaagccgaaccaccgcacgaccg

SEQ ID NO: 12 - DNA, 31 bp, synthetic construct
  source 1..31: mol_type = other DNA
tcgtggctggtcgtggcggtcgtgcggtggt

SEQ ID NO: 13 - DNA, 16 bp, synthetic construct
  source 1..16: mol_type = other DNA
ccacgaccagccacga

SEQ ID NO: 14 - DNA, 33 bp, synthetic construct; identical to SEQ ID NO: 10
  misc_feature 1: note = The nucleotide at position 1 is attached to (NVT30)-Bead.
  misc_feature 18..19: note = A UMI8 domain and BC14 domain are present between the nucleotides at positions 18 and 19.
  source 1..33: mol_type = other DNA

SEQ ID NO: 15 - DNA, 21 bp, synthetic construct
  source 1..21: mol_type = other DNA
agcagcaccgaccagcagaca

SEQ ID NO: 16 - DNA, 21 bp, synthetic construct
  source 1..21: mol_type = other DNA
agcagcaccgaccagcagaca

SEQ ID NO: 17 - DNA, 21 bp, synthetic construct
  source 1..21: mol_type = other DNA
acgagcaccgaccagcacaga

SEQ ID NO: 18 - DNA, 73 bp, synthetic construct
  misc_feature 21..23: note = GSP>sDNA--GSP is present between the nucleotides at positions 21 and 23.
  misc_feature 52..53: note = A BC14 domain and UMI8 domain are present between the nucleotides at positions 52 and 53.
  source 1..73: mol_type = other DNA
agcagcaccgaccagcagacaaccaccgcacgaccgccacgaccagccacgatctgtgctggtcggtgctcgt

SEQ ID NO: 19 - DNA, 73 bp, synthetic construct
  misc_feature 21..22: note = A BC14 domain and UMI8 domain are present between the nucleotides at positions 21 and 22.
  misc_feature 52: note = GSP>asDNA-GSP is present between the nucleotides at positions 21 and 22.
  source 1..73: mol_type = other DNA
acgagcaccgaccagcacagatcgtggctggtcgtggcggtcgtgcggtggttgtctgctggtcggtgctgct

SEQ ID NO: 20 - DNA, 43 bp, synthetic construct
  source 1..43: mol_type = other DNA
agcagaagacggcatacgagatagcagcaccgaccagcagaca

SEQ ID NO: 21 - DNA, 44 bp, synthetic construct
  source 1..44: mol_type = other DNA
acggcgaccaccgagatctacacacgagcaccgaccagcacaga

SEQ ID NO: 22 - DNA, 73 bp, synthetic construct; identical to SEQ ID NO: 18
  misc_feature 21..22: note = GSP>sDNA--GSP is present between the nucleotides at positions 21 and 22.
  misc_feature 52..53: note = A BC14 domain and UMI8 domain are present between the nucleotides at positions 52 and 53.
  source 1..73: mol_type = other DNA

SEQ ID NO: 23 - DNA, 73 bp, synthetic construct; identical to SEQ ID NO: 19
  misc_feature 21..22: note = A UMI8 domain and BC14 domain are present between the nucleotides at positions 21 and 22.
  misc_feature 52..53: note = GSP>asDNA-GSP is present between the nucleotides at positions 52 and 53.
  source 1..73: mol_type = other DNA

SEQ ID NO: 24 - DNA, 81 bp, synthetic construct
  variation 32: note = n is a, c, g, or t
  variation 35: note = n is a, c, g, or t
  variation 81: note = n is a, c, g, or t
  source 1..81: mol_type = other DNA
cggtcgtgcggtggttcggcttcctgggcbbnbbnbbtgtctgctggtcggtgctttttttttttttttttttttttttvn

SEQ ID NO: 25 - DNA, 16 bp, synthetic construct
  source 1..16: mol_type = other DNA
ccacgaccagccacga

SEQ ID NO: 26 - DNA, 33 bp, synthetic construct
  source 1..33: mol_type = other DNA
atcgtggctggtcgtggcggtcgtgcggtggta

SEQ ID NO: 27 - DNA, 33 bp, synthetic construct
  misc_feature 18..19: note = A UMI8 domain and BC14 domain are present between the nucleotides at positions.
  source 1..33: mol_type = other DNA
agcaccgaccagcagacaaccaccgcacgaccg

SEQ ID NO: 28 - DNA, 16 bp, synthetic construct
  source 1..16: mol_type = other DNA
ccacgaccagccacga

SEQ ID NO: 29 - DNA, 21 bp, synthetic construct
  source 1..21: mol_type = other DNA
acgagcaccgaccagcacaga

SEQ ID NO: 30 - DNA, 21 bp, synthetic construct
  source 1..21: mol_type = other DNA
agcagcaccgaccagcagaca

SEQ ID NO: 31 - DNA, 21 bp, synthetic construct
  source 1..21: mol_type = other DNA
acgagcaccgaccagcacaga

SEQ ID NO: 32 - DNA, 73 bp, synthetic construct; identical to SEQ ID NO: 18
  misc_feature 21..22: note = A UMI8 domain and BC14 domain are present between the nucleotides at positions 21 and 22.
  misc_feature 52..53: note = GSP>sDNA--GSP is present between the nucleotides at positions 52 and 53.
  source 1..73: mol_type = other DNA

SEQ ID NO: 33 - DNA, 73 bp, synthetic construct; identical to SEQ ID NO: 19
  misc_feature 21..22: note = GSP>sDNA--GSP is present between the nucleotides at positions 52 and 53.
  misc_feature 52..53: note = A UMI8 domain and BC14 domain are present between the nucleotides at positions 52 and 53.
  source 1..73: mol_type = other DNA

SEQ ID NO: 34 - DNA, 43 bp, synthetic construct; identical to SEQ ID NO: 20
  source 1..43: mol_type = other DNA

SEQ ID NO: 35 - DNA, 44 bp, synthetic construct; identical to SEQ ID NO: 21
  source 1..44: mol_type = other DNA

SEQ ID NO: 36 - DNA, 124 bp, synthetic construct
  misc_feature 46..47: note = A UMI8 domain and BC14 domain are present between the nucleotides present at positions 46 and 47.
  misc_feature 77..78: note = GSP>sDNA---sDNA-GSP are present between the nucleotides present at positions 46 and 47.
  source 1..124: mol_type = other DNA
agcagaagacggcatacgagatagcagcagcaccgaccagcagacaaccaccgcacgaccgccacgaccagccacgatctgtgctggtcggtgctcgtcgtgtgtagatctcggtggtcgccgt

SEQ ID NO: 37 - DNA, 124 bp, synthetic construct
  misc_feature 47..48: note = GSP>asDNA-asDNA-GSP ispresent between the nucleotides at positions 47 and 48.
  misc_feature 78..79: note = A UMI8 domain and BC14 domain are present between the nucleotides at positions 78 and 79.
  source 1..124: mol_type = other DNA
acggcgaccaccgagatctacacacgacgagcaccgaccagcacagatcgtggctggtcgtggcggtcgtgcggtggttgtctgctggtcggtgctgctgctatctcgtatgccgtcttctgct

SEQ ID NO: 38 - DNA, 23 bp, synthetic construct
  source 1..23: mol_type = other DNA
acgaccgccacgaccagccacga

SEQ ID NO: 39 - DNA, 28 bp, synthetic construct
  source 1..28: mol_type = other DNA
acgagatagcagcaccgaccagcagaca

SEQ ID NO: 40 - DNA, 28 bp, synthetic construct
  source 1..28: mol_type = other DNA
actacacacgagcaccgaccagcacaga

SEQ ID NO: 41 - DNA, 24 bp, synthetic construct
  source 1..24: mol_type = other DNA
tggtcgtggcggtcgtgcggtggt

SEQ ID NO: 42 - DNA, 13 bp, synthetic construct
  source 1..13: mol_type = other DNA
ccacgaccagcca

SEQ ID NO: 43 - DNA, 33 bp, synthetic construct
  misc_feature 1: note = The nucleotide at position 1is attached to and X-Bead moiety.
  misc_feature 21..22: note = A barcode domain is present between the nucleotides at positions 21 and 22.
  source 1..33: mol_type = other DNA
acgagcaccgaccagcacagaaccgcacgaccg

SEQ ID NO: 44 - DNA, 41 bp, synthetic construct
  source 1..41: mol_type = other DNA
acgagcaccgaccagcacagagaacaaacaccgcacgaccg

SEQ ID NO: 45 - DNA, 41 bp, synthetic construct
  source 1..41: mol_type = other DNA
acgagcaccgaccagcacagaggcgaaacaccgcacgaccg

SEQ ID NO: 46 - DNA, 41 bp, synthetic construct
  source 1..41: mol_type = other DNA
acgagcaccgaccagcacagagcaaaaggaccgcacgaccg

SEQ ID NO: 47 - skipped

SEQ ID NO: 48 - DNA, 44 bp, synthetic construct
  variation 21: note = n is a, c, g, or t
  variation 24: note = n is a, c, g, or t
  source 1..44: mol_type = other DNA
agcaccgaccagcacagavvnvvnvvcatcagaccgcacgaccg

SEQ ID NO: 49 - skipped

SEQ ID NO: 50 - DNA, 45 bp, synthetic construct
  variation 21: note = n is a, c, g, or t
  variation 24: note = n is a, c, g, or t
  source 1..45: mol_type = other DNA
agcaccgaccagcacagavvnvvnvvcagcatgaccgcacgaccg

SEQ ID NO: 51 - DNA, 46 bp, synthetic construct
  misc_feature 21..22: note = A barcode domain is present between the nucleotides at positions 21 and 22.
  source 1..46: mol_type = other DNA
acgagcaccgaccagcacagaaccgcacgaccgccacgaccagcca

SEQ ID NO: 52 - DNA, 46 bp, synthetic construct
  misc_feature 21..22: note = A barcode domain is present between the nucleotides at positions 21 and 22.
  source 1..46: mol_type = other DNA
agcagcaccgaccagcagacaaccgcacgaccgccacgaccagcca

SEQ ID NO: 53 - DNA, 20 bp, synthetic construct
  source 1..20: mol_type = other DNA
agcagcaccgaccagcagac

SEQ ID NO: 54 - DNA, 18 bp, synthetic construct
  source 1..18: mol_type = other DNA
agcaccgaccagcagaca

SEQ ID NO: 55 - DNA, 18 bp, synthetic construct
  source 1..18: mol_type = other DNA
agcaccgaccagcacaga

SEQ ID NO: 56 - DNA, 20 bp, synthetic construct
  source 1..20: mol_type = other DNA
acgagcaccgaccagcacag

SEQ ID NO: 57 - DNA, 20 bp, synthetic construct
  source 1..20: mol_type = other DNA
agcagcaccgaccagcagac

SEQ ID NO: 58 - DNA, 18 bp, synthetic construct
  source 1..18: mol_type = other DNA
agcaccgaccagcagaca

SEQ ID NO: 59 - DNA, 18 bp, synthetic construct
  source 1..18: mol_type = other DNA
agcaccgaccagcacaga

SEQ ID NO: 60 - DNA, 20 bp, synthetic construct
  source 1..20: mol_type = other DNA
acgagcaccgaccagcacag

SEQ ID NO: 61 - DNA, 42 bp, synthetic construct
  misc_feature 21..22: note = cDNA is present between the nucleotides at positions
  source 1..42: mol_type = other DNA
agcagcaccgaccagcagacatctgtgctggtcggtgctcgt

SEQ ID NO: 62 - DNA, 42 bp, synthetic construct
  misc_feature 21..22: note = cDNA is present between the nucleotides at positions 21 and 22.
  source 1..42: mol_type = other DNA
tcgtcgtggctggtcgtctgtagacacgaccagccacgagca

SEQ ID NO: 63 - DNA, 53 bp, synthetic construct
  source 1..53: mol_type = other DNA
agcagaagacggcatacgagatatacgacagcagcagcaccgaccagcagaca

SEQ ID NO: 64 - DNA, 53 bp, synthetic construct
  source 1..53: mol_type = other DNA
agcagaagacggcatacgagatactgatgagcagcagcaccgaccagcagaca

SEQ ID NO: 65 - DNA, 53 bp, synthetic construct
  source 1..53: mol_type = other DNA
agcagaagacggcatacgagatagcatcaagcagcagcaccgaccagcagaca

SEQ ID NO: 66 - DNA, 53 bp, synthetic construct
  source 1..53: mol_type = other DNA
agcagaagacggcatacgagataagtcgtagcagcagcaccgaccagcagaca

SEQ ID NO: 67 - DNA, 53 bp, synthetic construct
  source 1..53: mol_type = other DNA
agcagaagacggcatacgagatatcgcatagcagcagcaccgaccagcagaca

SEQ ID NO: 68 - DNA, 53 bp, synthetic construct
  source 1..53: mol_type = other DNA
agcagaagacggcatacgagatacatagcagcagcagcaccgaccagcagaca

SEQ ID NO: 69 - DNA, 54 bp, synthetic construct
  source 1..54: mol_type = other DNA
agacacgaccagccacgagcagcacagcatacacatctagagccaccagcggca

SEQ ID NO: 70 - DNA, 54 bp, synthetic construct
  source 1..54: mol_type = other DNA
agacacgaccagccacgagcagcagtagtcacacatctagagccaccagcggca

SEQ ID NO: 71 - DNA, 54 bp, synthetic construct
  source 1..54: mol_type = other DNA
agacacgaccagccacgagcagcaactacgacacatctagagccaccagcggca

SEQ ID NO: 72 - DNA, 54 bp, synthetic construct
  source 1..54: mol_type = other DNA
agacacgaccagccacgagcagcatgctgaacacatctagagccaccagcggca

SEQ ID NO: 73 - DNA, 54 bp, synthetic construct
  source 1..54: mol_type = other DNA
agacacgaccagccacgagcagcatacgctacacatctagagccaccagcggca

SEQ ID NO: 74 - DNA, 54 bp, synthetic construct
  source 1..54: mol_type = other DNA
agacacgaccagccacgagcagcacgatacacacatctagagccaccagcggca

SEQ ID NO: 75 - DNA, 46 bp, synthetic construct
  source 1..46: mol_type = other DNA
agcagaagacggcatacgagatagcagcagcaccgaccagcagaca

SEQ ID NO: 76 - DNA, 47 bp, synthetic construct
  source 1..47: mol_type = other DNA
agacacgaccagccacgagcagcacacatctagagccaccagcggca

SEQ ID NO: 77 - DNA, 42 bp, synthetic construct; identical to SEQ ID NO: 61
  misc_feature 21..22: note = cDNA is present between the nucleotides at position 21 and 22.
  source 1..42: mol_type = other DNA

SEQ ID NO: 78 - DNA, 42 bp, synthetic construct; identical to SEQ ID NO: 62
  misc_feature 21..22: note = cDNA is present between the nucleotides at positions 21 and 22.
  source 1..42: mol_type = other DNA

SEQ ID NO: 79 - DNA, 25 bp, synthetic construct
  source 1..25: mol_type = other DNA
tggctggtcgtggcggtcgtgcggt

SEQ ID NO: 80 - DNA, 24 bp, synthetic construct
  source 1..24: mol_type = other DNA
agcagcagcaccgaccagcagaca

SEQ ID NO: 81 - DNA, 25 bp, synthetic construct
  source 1..25: mol_type = other DNA
accgaccagcaccgccagcacgcca

SEQ ID NO: 82 - DNA, 24 bp, synthetic construct
  source 1..24: mol_type = other DNA
tctgtgctggtcggtgctcgtcgt

SEQ ID NO: 83 - DNA, 24 bp, synthetic construct
  source 1..24: mol_type = other DNA
agacacgaccagccacgagcagca

SEQ ID NO: 84 - DNA, 26 bp, synthetic construct
  source 1..26: mol_type = other DNA
atggctggtcgtggcggtcgtgcggt

SEQ ID NO: 85 - DNA, 14 bp, synthetic construct
  source 1..14: mol_type = other DNA
gcccaggaagccga

SEQ ID NO: 86 - DNA, 14 bp, synthetic construct
  source 1..14: mol_type = other DNA
ccacggccaacgcc

SEQ ID NO: 87 - DNA, 14 bp, synthetic construct
  source 1..14: mol_type = other DNA
gccaagggaccagc

SEQ ID NO: 88 - DNA, 14 bp, synthetic construct
  source 1..14: mol_type = other DNA
gaccgcagccgagg

SEQ ID NO: 89 - DNA, 14 bp, synthetic construct
  source 1..14: mol_type = other DNA
accacagaacccaa

SEQ ID NO: 90 - DNA, 14 bp, synthetic construct
  source 1..14: mol_type = other DNA
cgacagggggagag

SEQ ID NO: 91 - DNA, 14 bp, synthetic construct
  source 1..14: mol_type = other DNA
ggaagagcaccggg

SEQ ID NO: 92 - DNA, 14 bp, synthetic construct
  source 1..14: mol_type = other DNA
gcccgaagcacgga

SEQ ID NO: 93 - DNA, 14 bp, synthetic construct
  source 1..14: mol_type = other DNA
gacagccgaccaac

SEQ ID NO: 94 - DNA, 14 bp, synthetic construct
  source 1..14: mol_type = other DNA
gaggcaaggggccc

SEQ ID NO: 95 - DNA, 14 bp, synthetic construct
  source 1..14: mol_type = other DNA
acgagcagcagagg

SEQ ID NO: 96 - DNA, 14 bp, synthetic construct
  source 1..14: mol_type = other DNA
ccccagcgcagaca

SEQ ID NO: 97 - DNA, 14 bp, synthetic construct
  source 1..14: mol_type = other DNA
agacaaagccgaag

SEQ ID NO: 98 - DNA, 14 bp, synthetic construct
  source 1..14: mol_type = other DNA
caccgaggggaacg

SEQ ID NO: 99 - DNA, 14 bp, synthetic construct
  source 1..14: mol_type = other DNA
caagcgcgacacga

SEQ ID NO: 100 - DNA, 14 bp, synthetic construct
  source 1..14: mol_type = other DNA
cacccgaaagccag

SEQ ID NO: 101 - DNA, 14 bp, synthetic construct
  source 1..14: mol_type = other DNA
gcgagcgagacgag

SEQ ID NO: 102 - DNA, 14 bp, synthetic construct
  source 1..14: mol_type = other DNA
agaggagcaaggga

SEQ ID NO: 103 - DNA, 14 bp, synthetic construct
  source 1..14: mol_type = other DNA
gacggtcccgacac

SEQ ID NO: 104 - DNA, 14 bp, synthetic construct
  source 1..14: mol_type = other DNA
atacgaacgacggc

SEQ ID NO: 105 - DNA, 14 bp, synthetic construct
  source 1..14: mol_type = other DNA
agctcggccaagaa

SEQ ID NO: 106 - DNA, 14 bp, synthetic construct
  source 1..14: mol_type = other DNA
acgagagtagccga

SEQ ID NO: 107 - DNA, 14 bp, synthetic construct
  source 1..14: mol_type = other DNA
atgagcggaaagaa

SEQ ID NO: 108 - DNA, 14 bp, synthetic construct
  source 1..14: mol_type = other DNA
ggcaaaaacccatc

SEQ ID NO: 109 - DNA, 14 bp, synthetic construct
  source 1..14: mol_type = other DNA
aggggagacccgtc

SEQ ID NO: 110 - DNA, 14 bp, synthetic construct
  source 1..14: mol_type = other DNA
agcaagggcctgcg

SEQ ID NO: 111 - DNA, 14 bp, synthetic construct
  source 1..14: mol_type = other DNA
gccgcaaagtggga

SEQ ID NO: 112 - DNA, 14 bp, synthetic construct
  source 1..14: mol_type = other DNA
gcccaaagtcgaac

SEQ ID NO: 113 - DNA, 14 bp, synthetic construct
  source 1..14: mol_type = other DNA
caaggtcgccggga

SEQ ID NO: 114 - DNA, 14 bp, synthetic construct
  source 1..14: mol_type = other DNA
aatgacggcaagcc

SEQ ID NO: 115 - DNA, 14 bp, synthetic construct
  source 1..14: mol_type = other DNA
gagccacgagtcac

SEQ ID NO: 116 - DNA, 14 bp, synthetic construct
  source 1..14: mol_type = other DNA
gaggcgcaatacac

SEQ ID NO: 117 - DNA, 14 bp, synthetic construct
  source 1..14: mol_type = other DNA
tagggaaccacacc

SEQ ID NO: 118 - DNA, 14 bp, synthetic construct
  source 1..14: mol_type = other DNA
ggggaatgaccaga

SEQ ID NO: 119 - DNA, 14 bp, synthetic construct
  source 1..14: mol_type = other DNA
atgaagaaacaagg

SEQ ID NO: 120 - DNA, 14 bp, synthetic construct
  source 1..14: mol_type = other DNA
aacacgagcggtag

SEQ ID NO: 121 - DNA, 14 bp, synthetic construct
  source 1..14: mol_type = other DNA
ggggacgactacga

SEQ ID NO: 122 - DNA, 14 bp, synthetic construct
  source 1..14: mol_type = other DNA
ggagacaaggggct

SEQ ID NO: 123 - DNA, 14 bp, synthetic construct
  source 1..14: mol_type = other DNA
cctgcaaaggaacg

SEQ ID NO: 124 - DNA, 14 bp, synthetic construct
  source 1..14: mol_type = other DNA
gcgaatggaaagca

SEQ ID NO: 125 - DNA, 14 bp, synthetic construct
  source 1..14: mol_type = other DNA
cgggctcggacaca

SEQ ID NO: 126 - DNA, 14 bp, synthetic construct
  source 1..14: mol_type = other DNA
ggagcgacgtaaac

SEQ ID NO: 127 - DNA, 14 bp, synthetic construct
  source 1..14: mol_type = other DNA
cttacaccggaagc

SEQ ID NO: 128 - DNA, 14 bp, synthetic construct
  source 1..14: mol_type = other DNA
aatggagaagccta

SEQ ID NO: 129 - DNA, 14 bp, synthetic construct
  source 1..14: mol_type = other DNA
gagcgacacgctat

SEQ ID NO: 130 - DNA, 14 bp, synthetic construct
  source 1..14: mol_type = other DNA
atggtcaaaaacga

SEQ ID NO: 131 - DNA, 14 bp, synthetic construct
  source 1..14: mol_type = other DNA
ccggacgtgtaaac

SEQ ID NO: 132 - DNA, 14 bp, synthetic construct
  source 1..14: mol_type = other DNA
atgcgacaaatagc

SEQ ID NO: 133 - DNA, 14 bp, synthetic construct
  source 1..14: mol_type = other DNA
cgttcgaggagcac

SEQ ID NO: 134 - DNA, 14 bp, synthetic construct
  source 1..14: mol_type = other DNA
cgtcggaacaacat

SEQ ID NO: 135 - DNA, 14 bp, synthetic construct
  source 1..14: mol_type = other DNA
tgcatcggccaccg

SEQ ID NO: 136 - DNA, 14 bp, synthetic construct
  source 1..14: mol_type = other DNA
ttcgcacaccaagc

SEQ ID NO: 137 - DNA, 14 bp, synthetic construct
  source 1..14: mol_type = other DNA
gatgacccgaagat

SEQ ID NO: 138 - DNA, 14 bp, synthetic construct
  source 1..14: mol_type = other DNA
gcttgggagagggc

SEQ ID NO: 139 - DNA, 14 bp, synthetic construct
  source 1..14: mol_type = other DNA
aacacctggatggg

SEQ ID NO: 140 - DNA, 14 bp, synthetic construct
  source 1..14: mol_type = other DNA
ccactcgctccgca

SEQ ID NO: 141 - DNA, 14 bp, synthetic construct
  source 1..14: mol_type = other DNA
atcaagcggtgaag

SEQ ID NO: 142 - DNA, 14 bp, synthetic construct
  source 1..14: mol_type = other DNA
agcaggcgaagtta

SEQ ID NO: 143 - DNA, 14 bp, synthetic construct
  source 1..14: mol_type = other DNA
cgagggtcgagtcg

SEQ ID NO: 144 - DNA, 14 bp, synthetic construct
  source 1..14: mol_type = other DNA
acccaaaaacttcg

SEQ ID NO: 145 - DNA, 14 bp, synthetic construct
  source 1..14: mol_type = other DNA
aggctggaggatag

SEQ ID NO: 146 - DNA, 14 bp, synthetic construct
  source 1..14: mol_type = other DNA
tgatccagaggcca

SEQ ID NO: 147 - DNA, 14 bp, synthetic construct
  source 1..14: mol_type = other DNA
aagaccacttccca

SEQ ID NO: 148 - DNA, 14 bp, synthetic construct
  source 1..14: mol_type = other DNA
agatgtagcggagg

SEQ ID NO: 149 - DNA, 14 bp, synthetic construct
  source 1..14: mol_type = other DNA
gaaacgcacctgct

SEQ ID NO: 150 - DNA, 14 bp, synthetic construct
  source 1..14: mol_type = other DNA
agggcagtaggact

SEQ ID NO: 151 - DNA, 14 bp, synthetic construct
  source 1..14: mol_type = other DNA
gatcctaaccaacc

SEQ ID NO: 152 - DNA, 14 bp, synthetic construct
  source 1..14: mol_type = other DNA
cagcgtcgcgagtg

SEQ ID NO: 153 - DNA, 14 bp, synthetic construct
  source 1..14: mol_type = other DNA
gtactaacacagca

SEQ ID NO: 154 - DNA, 14 bp, synthetic construct
  source 1..14: mol_type = other DNA
agaggtgaacaaat

SEQ ID NO: 155 - DNA, 14 bp, synthetic construct
  source 1..14: mol_type = other DNA
cccctaagggcctg

SEQ ID NO: 156 - DNA, 14 bp, synthetic construct
  source 1..14: mol_type = other DNA
tgccgtcgcgaaac

SEQ ID NO: 157 - DNA, 14 bp, synthetic construct
  source 1..14: mol_type = other DNA
ccacatcgcaacct

SEQ ID NO: 158 - DNA, 14 bp, synthetic construct
  source 1..14: mol_type = other DNA
gcggctgcctcacg

SEQ ID NO: 159 - DNA, 14 bp, synthetic construct
  source 1..14: mol_type = other DNA
cactacaaggggat

SEQ ID NO: 160 - DNA, 14 bp, synthetic construct
  source 1..14: mol_type = other DNA
tagaccccctgacc

SEQ ID NO: 161 - DNA, 14 bp, synthetic construct
  source 1..14: mol_type = other DNA
accgggaacttacc

SEQ ID NO: 162 - DNA, 14 bp, synthetic construct
  source 1..14: mol_type = other DNA
tagataaccgggca

SEQ ID NO: 163 - DNA, 14 bp, synthetic construct
  source 1..14: mol_type = other DNA
ctgggggaagcaat

SEQ ID NO: 164 - DNA, 14 bp, synthetic construct
  source 1..14: mol_type = other DNA
cggctatggcccag

SEQ ID NO: 165 - DNA, 14 bp, synthetic construct
  source 1..14: mol_type = other DNA
tctgcgaggggcga

SEQ ID NO: 166 - DNA, 14 bp, synthetic construct
  source 1..14: mol_type = other DNA
cccaggggcttcga

SEQ ID NO: 167 - DNA, 14 bp, synthetic construct
  source 1..14: mol_type = other DNA
tggggacctgcgac

SEQ ID NO: 168 - DNA, 14 bp, synthetic construct
  source 1..14: mol_type = other DNA
gcattagcagagcg

SEQ ID NO: 169 - DNA, 14 bp, synthetic construct
  source 1..14: mol_type = other DNA
tgagaccacagtcg

SEQ ID NO: 170 - DNA, 14 bp, synthetic construct
  source 1..14: mol_type = other DNA
ctcggcgatctcaa

SEQ ID NO: 171 - DNA, 14 bp, synthetic construct
  source 1..14: mol_type = other DNA
cggtattgagagcg

SEQ ID NO: 172 - DNA, 14 bp, synthetic construct
  source 1..14: mol_type = other DNA
ccttggtcccgaag

SEQ ID NO: 173 - DNA, 14 bp, synthetic construct
  source 1..14: mol_type = other DNA
tgatcgacctcggc

SEQ ID NO: 174 - DNA, 14 bp, synthetic construct
  source 1..14: mol_type = other DNA
tgcgggtggtgacc

SEQ ID NO: 175 - DNA, 14 bp, synthetic construct
  source 1..14: mol_type = other DNA
tccacctagggctg

SEQ ID NO: 176 - DNA, 14 bp, synthetic construct
  source 1..14: mol_type = other DNA
gcacctgctggata

SEQ ID NO: 177 - DNA, 14 bp, synthetic construct
  source 1..14: mol_type = other DNA
gccctgccgcttga

SEQ ID NO: 178 - DNA, 14 bp, synthetic construct
  source 1..14: mol_type = other DNA
gggcatctagaata

SEQ ID NO: 179 - DNA, 14 bp, synthetic construct
  source 1..14: mol_type = other DNA
aggttgtgggcggg

SEQ ID NO: 180 - DNA, 14 bp, synthetic construct
  source 1..14: mol_type = other DNA
tactcccgtcaaca

SEQ ID NO: 181 - DNA, 14 bp, synthetic construct
  source 1..14: mol_type = other DNA
taaagctgagtcaa

SEQ ID NO: 182 - DNA, 14 bp, synthetic construct
  source 1..14: mol_type = other DNA
gtacgcaaattagc

SEQ ID NO: 183 - DNA, 14 bp, synthetic construct
  source 1..14: mol_type = other DNA
gtaagtgggctagg

SEQ ID NO: 184 - DNA, 14 bp, synthetic construct
  source 1..14: mol_type = other DNA
tatggcgcaacgta

SEQ ID NO: 185 - DNA, 14 bp, synthetic construct
  source 1..14: mol_type = other DNA
accagacgtctgta

SEQ ID NO: 186 - DNA, 14 bp, synthetic construct
  source 1..14: mol_type = other DNA
ggtaatacgctacg

SEQ ID NO: 187 - DNA, 14 bp, synthetic construct
  source 1..14: mol_type = other DNA
actcccctcgtaac

SEQ ID NO: 188 - DNA, 14 bp, synthetic construct
  source 1..14: mol_type = other DNA
cacgtggctccgct

SEQ ID NO: 189 - DNA, 14 bp, synthetic construct
  source 1..14: mol_type = other DNA
acggcgtactatac

SEQ ID NO: 190 - DNA, 14 bp, synthetic construct
  source 1..14: mol_type = other DNA
gccaacgtatatca

SEQ ID NO: 191 - DNA, 14 bp, synthetic construct
  source 1..14: mol_type = other DNA
cttaaacccgtcag

SEQ ID NO: 192 - DNA, 14 bp, synthetic construct
  source 1..14: mol_type = other DNA
cctgttgcggaagg

SEQ ID NO: 193 - DNA, 14 bp, synthetic construct
  source 1..14: mol_type = other DNA
acattgcggtccgc

SEQ ID NO: 194 - DNA, 14 bp, synthetic construct
  source 1..14: mol_type = other DNA
gagacactgcttcg

SEQ ID NO: 195 - DNA, 14 bp, synthetic construct
  source 1..14: mol_type = other DNA
actatacccggtca

SEQ ID NO: 196 - DNA, 14 bp, synthetic construct
  source 1..14: mol_type = other DNA
gtccacctgtgaca

SEQ ID NO: 197 - DNA, 14 bp, synthetic construct
  source 1..14: mol_type = other DNA
gcatcaggcggttc

SEQ ID NO: 198 - DNA, 14 bp, synthetic construct
  source 1..14: mol_type = other DNA
atcaaggaggcttc

SEQ ID NO: 199 - DNA, 14 bp, synthetic construct
  source 1..14: mol_type = other DNA
gtgccttaaaggca

SEQ ID NO: 200 - DNA, 14 bp, synthetic construct
  source 1..14: mol_type = other DNA
tggcctccacagtg

SEQ ID NO: 201 - DNA, 14 bp, synthetic construct
  source 1..14: mol_type = other DNA
tgaggaggacttcg

SEQ ID NO: 202 - DNA, 14 bp, synthetic construct
  source 1..14: mol_type = other DNA
gtcccgagctcgtc

SEQ ID NO: 203 - DNA, 14 bp, synthetic construct
  source 1..14: mol_type = other DNA
cagctattccgagg

SEQ ID NO: 204 - DNA, 14 bp, synthetic construct
  source 1..14: mol_type = other DNA
taagatcccaagct

SEQ ID NO: 205 - DNA, 14 bp, synthetic construct
  source 1..14: mol_type = other DNA
accccatagctgct

SEQ ID NO: 206 - DNA, 14 bp, synthetic construct
  source 1..14: mol_type = other DNA
agctgcctgtacca

SEQ ID NO: 207 - DNA, 14 bp, synthetic construct
  source 1..14: mol_type = other DNA
tcagacattaaaaa

SEQ ID NO: 208 - DNA, 14 bp, synthetic construct
  source 1..14: mol_type = other DNA
agtagaggtggtag

SEQ ID NO: 209 - DNA, 14 bp, synthetic construct
  source 1..14: mol_type = other DNA
atgtgctacgcccg

SEQ ID NO: 210 - DNA, 14 bp, synthetic construct
  source 1..14: mol_type = other DNA
cgcagaaatattcg

SEQ ID NO: 211 - DNA, 14 bp, synthetic construct
  source 1..14: mol_type = other DNA
cggtgcctataggg

SEQ ID NO: 212 - DNA, 14 bp, synthetic construct
  source 1..14: mol_type = other DNA
ccccgtctgactca

SEQ ID NO: 213 - DNA, 14 bp, synthetic construct
  source 1..14: mol_type = other DNA
gtagcagatgacgt

SEQ ID NO: 214 - DNA, 14 bp, synthetic construct
  source 1..14: mol_type = other DNA
aggaaaggcatctt

SEQ ID NO: 215 - DNA, 14 bp, synthetic construct
  source 1..14: mol_type = other DNA
gaacagcattgtaa

SEQ ID NO: 216 - DNA, 14 bp, synthetic construct
  source 1..14: mol_type = other DNA
cccgatctaaatgc

SEQ ID NO: 217 - DNA, 14 bp, synthetic construct
  source 1..14: mol_type = other DNA
cggtgcccaagatt

SEQ ID NO: 218 - DNA, 14 bp, synthetic construct
  source 1..14: mol_type = other DNA
gaatccgcagttca

SEQ ID NO: 219 - DNA, 14 bp, synthetic construct
  source 1..14: mol_type = other DNA
gtaacagccttgca

SEQ ID NO: 220 - DNA, 14 bp, synthetic construct
  source 1..14: mol_type = other DNA
tattaaagcgaagg

SEQ ID NO: 221 - DNA, 14 bp, synthetic construct
  source 1..14: mol_type = other DNA
gaactgagtgagta

SEQ ID NO: 222 - DNA, 14 bp, synthetic construct
  source 1..14: mol_type = other DNA
tccaagactgacgt

SEQ ID NO: 223 - DNA, 14 bp, synthetic construct
  source 1..14: mol_type = other DNA
cataagattcgcac

SEQ ID NO: 224 - DNA, 14 bp, synthetic construct
  source 1..14: mol_type = other DNA
agggctgatgtgaa

SEQ ID NO: 225 - DNA, 14 bp, synthetic construct
  source 1..14: mol_type = other DNA
agaccatactaatg

SEQ ID NO: 226 - DNA, 14 bp, synthetic construct
  source 1..14: mol_type = other DNA
gaaccggacatctt

SEQ ID NO: 227 - DNA, 14 bp, synthetic construct
  source 1..14: mol_type = other DNA
aatactgaggtccg

SEQ ID NO: 228 - DNA, 14 bp, synthetic construct
  source 1..14: mol_type = other DNA
acgttggtcgaaga

SEQ ID NO: 229 - DNA, 14 bp, synthetic construct
  source 1..14: mol_type = other DNA
gctagtggaccgta

SEQ ID NO: 230 - DNA, 14 bp, synthetic construct
  source 1..14: mol_type = other DNA
agacgcctatcgtg

SEQ ID NO: 231 - DNA, 14 bp, synthetic construct
  source 1..14: mol_type = other DNA
gtcagacaagctct

SEQ ID NO: 232 - DNA, 14 bp, synthetic construct
  source 1..14: mol_type = other DNA
gttgcaagtccgca

SEQ ID NO: 233 - DNA, 14 bp, synthetic construct
  source 1..14: mol_type = other DNA
gcgaaccatattgc

SEQ ID NO: 234 - DNA, 14 bp, synthetic construct
  source 1..14: mol_type = other DNA
ttcatagaggcacg

SEQ ID NO: 235 - DNA, 14 bp, synthetic construct
  source 1..14: mol_type = other DNA
ttcaccgggagtaa

SEQ ID NO: 236 - DNA, 14 bp, synthetic construct
  source 1..14: mol_type = other DNA
gacttgaatcggaa

SEQ ID NO: 237 - DNA, 14 bp, synthetic construct
  source 1..14: mol_type = other DNA
cttgggagtgagac

SEQ ID NO: 238 - DNA, 14 bp, synthetic construct
  source 1..14: mol_type = other DNA
gccagataatgcat

SEQ ID NO: 239 - DNA, 14 bp, synthetic construct
  source 1..14: mol_type = other DNA
actaaaccgttccc

SEQ ID NO: 240 - DNA, 14 bp, synthetic construct
  source 1..14: mol_type = other DNA
tcgcgctggcactg

SEQ ID NO: 241 - DNA, 14 bp, synthetic construct
  source 1..14: mol_type = other DNA
tacacgtacgtccg

SEQ ID NO: 242 - DNA, 14 bp, synthetic construct
  source 1..14: mol_type = other DNA
agagccggtttcaa

SEQ ID NO: 243 - DNA, 14 bp, synthetic construct
  source 1..14: mol_type = other DNA
caaatactgctgga

SEQ ID NO: 244 - DNA, 14 bp, synthetic construct
  source 1..14: mol_type = other DNA
ctcgcgacagtcgt

SEQ ID NO: 245 - DNA, 14 bp, synthetic construct
  source 1..14: mol_type = other DNA
gaatctaccgctgc

SEQ ID NO: 246 - DNA, 14 bp, synthetic construct
  source 1..14: mol_type = other DNA
ccaggggaaattat

SEQ ID NO: 247 - DNA, 14 bp, synthetic construct
  source 1..14: mol_type = other DNA
tcgttaagcgcacg

SEQ ID NO: 248 - DNA, 14 bp, synthetic construct
  source 1..14: mol_type = other DNA
caagaggctctagt

SEQ ID NO: 249 - DNA, 14 bp, synthetic construct
  source 1..14: mol_type = other DNA
ctagtgaactgagg

SEQ ID NO: 250 - DNA, 14 bp, synthetic construct
  source 1..14: mol_type = other DNA
cccgaagttcactc

SEQ ID NO: 251 - DNA, 14 bp, synthetic construct
  source 1..14: mol_type = other DNA
taacgagtggatag

SEQ ID NO: 252 - DNA, 14 bp, synthetic construct
  source 1..14: mol_type = other DNA
cgacgtttgcgaga

SEQ ID NO: 253 - DNA, 14 bp, synthetic construct
  source 1..14: mol_type = other DNA
agtactgaatccca

SEQ ID NO: 254 - DNA, 14 bp, synthetic construct
  source 1..14: mol_type = other DNA
gaacgtcggctgat

SEQ ID NO: 255 - DNA, 14 bp, synthetic construct
  source 1..14: mol_type = other DNA
agggtgcggcactt

SEQ ID NO: 256 - DNA, 14 bp, synthetic construct
  source 1..14: mol_type = other DNA
ttagggtcgccgtc

SEQ ID NO: 257 - DNA, 14 bp, synthetic construct
  source 1..14: mol_type = other DNA
atacagttccagtg

SEQ ID NO: 258 - DNA, 14 bp, synthetic construct
  source 1..14: mol_type = other DNA
atgcctgctcagtc

SEQ ID NO: 259 - DNA, 14 bp, synthetic construct
  source 1..14: mol_type = other DNA
ctttagccatcacg

SEQ ID NO: 260 - DNA, 14 bp, synthetic construct
  source 1..14: mol_type = other DNA
ctgaaaaatctgat

SEQ ID NO: 261 - DNA, 14 bp, synthetic construct
  source 1..14: mol_type = other DNA
atgtaggccctggt

SEQ ID NO: 262 - DNA, 14 bp, synthetic construct
  source 1..14: mol_type = other DNA
taccttaagtggaa

SEQ ID NO: 263 - DNA, 14 bp, synthetic construct
  source 1..14: mol_type = other DNA
ttcggacaggtcct

SEQ ID NO: 264 - DNA, 14 bp, synthetic construct
  source 1..14: mol_type = other DNA
ggtctgtcggctca

SEQ ID NO: 265 - DNA, 14 bp, synthetic construct
  source 1..14: mol_type = other DNA
ccctcagcagttct

SEQ ID NO: 266 - DNA, 14 bp, synthetic construct
  source 1..14: mol_type = other DNA
ccgtgcaccggttt

SEQ ID NO: 267 - DNA, 14 bp, synthetic construct
  source 1..14: mol_type = other DNA
gttattccgcgaag

SEQ ID NO: 268 - DNA, 14 bp, synthetic construct
  source 1..14: mol_type = other DNA
atttaacggaatac

SEQ ID NO: 269 - DNA, 14 bp, synthetic construct
  source 1..14: mol_type = other DNA
cagagatttctgag

SEQ ID NO: 270 - DNA, 14 bp, synthetic construct
  source 1..14: mol_type = other DNA
ctcatgactgaatc

SEQ ID NO: 271 - DNA, 14 bp, synthetic construct
  source 1..14: mol_type = other DNA
gtggctgccggttc

SEQ ID NO: 272 - DNA, 14 bp, synthetic construct
  source 1..14: mol_type = other DNA
gtgcaggaattgtg

SEQ ID NO: 273 - DNA, 14 bp, synthetic construct
  source 1..14: mol_type = other DNA
caaatgtactcgtg

SEQ ID NO: 274 - DNA, 14 bp, synthetic construct
  source 1..14: mol_type = other DNA
gttaggtaacgtca

SEQ ID NO: 275 - DNA, 14 bp, synthetic construct
  source 1..14: mol_type = other DNA
tctaagtgtagcac

SEQ ID NO: 276 - DNA, 14 bp, synthetic construct
  source 1..14: mol_type = other DNA
tcagtgactaccat

SEQ ID NO: 277 - DNA, 14 bp, synthetic construct
  source 1..14: mol_type = other DNA
gtcttcaacagctg

SEQ ID NO: 278 - DNA, 14 bp, synthetic construct
  source 1..14: mol_type = other DNA
ataaaactctagct

SEQ ID NO: 279 - DNA, 14 bp, synthetic construct
  source 1..14: mol_type = other DNA
ctgggtgttggcgc

SEQ ID NO: 280 - DNA, 14 bp, synthetic construct
  source 1..14: mol_type = other DNA
ggctcatagtgagt

SEQ ID NO: 281 - DNA, 14 bp, synthetic construct
  source 1..14: mol_type = other DNA
gtgcagttgtaggg

SEQ ID NO: 282 - DNA, 14 bp, synthetic construct
  source 1..14: mol_type = other DNA
tcgcaagacttatg

SEQ ID NO: 283 - DNA, 14 bp, synthetic construct
  source 1..14: mol_type = other DNA
cgcatttagcagta

SEQ ID NO: 284 - DNA, 14 bp, synthetic construct
  source 1..14: mol_type = other DNA
cttcagggaatggt

SEQ ID NO: 285 - DNA, 14 bp, synthetic construct
  source 1..14: mol_type = other DNA
agcacatttggctc

SEQ ID NO: 286 - DNA, 14 bp, synthetic construct
  source 1..14: mol_type = other DNA
acccgagattttac

SEQ ID NO: 287 - DNA, 14 bp, synthetic construct
  source 1..14: mol_type = other DNA
ggtagcaatgtatc

SEQ ID NO: 288 - DNA, 14 bp, synthetic construct
  source 1..14: mol_type = other DNA
ggaatgtagctatc

SEQ ID NO: 289 - DNA, 14 bp, synthetic construct
  source 1..14: mol_type = other DNA
gagattctaacaat

SEQ ID NO: 290 - DNA, 14 bp, synthetic construct
  source 1..14: mol_type = other DNA
cgctcatcatatcg

SEQ ID NO: 291 - DNA, 14 bp, synthetic construct
  source 1..14: mol_type = other DNA
aaaagtagttcgtc

SEQ ID NO: 292 - DNA, 14 bp, synthetic construct
  source 1..14: mol_type = other DNA
atgacaactaatgt

SEQ ID NO: 293 - DNA, 14 bp, synthetic construct
  source 1..14: mol_type = other DNA
aattgaatcctaac

SEQ ID NO: 294 - DNA, 14 bp, synthetic construct
  source 1..14: mol_type = other DNA
tctggaaagagtct

SEQ ID NO: 295 - DNA, 14 bp, synthetic construct
  source 1..14: mol_type = other DNA
atgtaccgatagtc

SEQ ID NO: 296 - DNA, 14 bp, synthetic construct
  source 1..14: mol_type = other DNA
actaggcgttccgt

SEQ ID NO: 297 - DNA, 14 bp, synthetic construct
  source 1..14: mol_type = other DNA
ggtcgcacttaatg

SEQ ID NO: 298 - DNA, 14 bp, synthetic construct
  source 1..14: mol_type = other DNA
tcgtataacggctc

SEQ ID NO: 299 - DNA, 14 bp, synthetic construct
  source 1..14: mol_type = other DNA
tccgacaggtgctt

SEQ ID NO: 300 - DNA, 14 bp, synthetic construct
  source 1..14: mol_type = other DNA
atggagttcagctc

SEQ ID NO: 301 - DNA, 14 bp, synthetic construct
  source 1..14: mol_type = other DNA
cggcttactcagat

SEQ ID NO: 302 - DNA, 14 bp, synthetic construct
  source 1..14: mol_type = other DNA
ctgtcactgcatac

SEQ ID NO: 303 - DNA, 14 bp, synthetic construct
  source 1..14: mol_type = other DNA
ggcgtttcactaaa

SEQ ID NO: 304 - DNA, 14 bp, synthetic construct
  source 1..14: mol_type = other DNA
acattttacgcagc

SEQ ID NO: 305 - DNA, 14 bp, synthetic construct
  source 1..14: mol_type = other DNA
cattcataacatga

SEQ ID NO: 306 - DNA, 14 bp, synthetic construct
  source 1..14: mol_type = other DNA
aatatatgcgaatg

SEQ ID NO: 307 - DNA, 14 bp, synthetic construct
  source 1..14: mol_type = other DNA
cgtttaaccacata

SEQ ID NO: 308 - DNA, 14 bp, synthetic construct
  source 1..14: mol_type = other DNA
cgaactagttgaat

SEQ ID NO: 309 - DNA, 14 bp, synthetic construct
  source 1..14: mol_type = other DNA
gatttaagacggtc

SEQ ID NO: 310 - DNA, 14 bp, synthetic construct
  source 1..14: mol_type = other DNA
attagcgcactctg

SEQ ID NO: 311 - DNA, 14 bp, synthetic construct
  source 1..14: mol_type = other DNA
actttgcctaaaga

SEQ ID NO: 312 - DNA, 14 bp, synthetic construct
  source 1..14: mol_type = other DNA
ttgctgcctgcccg

SEQ ID NO: 313 - DNA, 14 bp, synthetic construct
  source 1..14: mol_type = other DNA
ccacattgtcatgg

SEQ ID NO: 314 - DNA, 14 bp, synthetic construct
  source 1..14: mol_type = other DNA
cctatcccgctcct

SEQ ID NO: 315 - DNA, 14 bp, synthetic construct
  source 1..14: mol_type = other DNA
cgtatcgattcgca

SEQ ID NO: 316 - DNA, 14 bp, synthetic construct
  source 1..14: mol_type = other DNA
cgtaagtgtgagtg

SEQ ID NO: 317 - DNA, 14 bp, synthetic construct
  source 1..14: mol_type = other DNA
gtccgatgactcat

SEQ ID NO: 318 - DNA, 14 bp, synthetic construct
  source 1..14: mol_type = other DNA
tcgaacccttgtac

SEQ ID NO: 319 - DNA, 14 bp, synthetic construct
  source 1..14: mol_type = other DNA
aacctctataccgt

SEQ ID NO: 320 - DNA, 14 bp, synthetic construct
  source 1..14: mol_type = other DNA
cgttgcagcacgtt

SEQ ID NO: 321 - DNA, 14 bp, synthetic construct
  source 1..14: mol_type = other DNA
tcgttcgtcgggcg

SEQ ID NO: 322 - DNA, 14 bp, synthetic construct
  source 1..14: mol_type = other DNA
cggtaaattatgag

SEQ ID NO: 323 - DNA, 14 bp, synthetic construct
  source 1..14: mol_type = other DNA
actgacgcgattta

SEQ ID NO: 324 - DNA, 14 bp, synthetic construct
  source 1..14: mol_type = other DNA
ctgtagatgcccgt

SEQ ID NO: 325 - DNA, 14 bp, synthetic construct
  source 1..14: mol_type = other DNA
cctaagttcgacgt

SEQ ID NO: 326 - DNA, 14 bp, synthetic construct
  source 1..14: mol_type = other DNA
atgagtctcgcctg

SEQ ID NO: 327 - DNA, 14 bp, synthetic construct
  source 1..14: mol_type = other DNA
aatgtaaatctgca

SEQ ID NO: 328 - DNA, 14 bp, synthetic construct
  source 1..14: mol_type = other DNA
cctctacccaattc

SEQ ID NO: 329 - DNA, 14 bp, synthetic construct
  source 1..14: mol_type = other DNA
gttggtcgcaagtg

SEQ ID NO: 330 - DNA, 14 bp, synthetic construct
  source 1..14: mol_type = other DNA
cgctgcctacttag

SEQ ID NO: 331 - DNA, 14 bp, synthetic construct
  source 1..14: mol_type = other DNA
ttaacagagattgg

SEQ ID NO: 332 - DNA, 14 bp, synthetic construct
  source 1..14: mol_type = other DNA
tcagttaggtagcg

SEQ ID NO: 333 - DNA, 14 bp, synthetic construct
  source 1..14: mol_type = other DNA
cacaatgttctcgg

SEQ ID NO: 334 - DNA, 14 bp, synthetic construct
  source 1..14: mol_type = other DNA
atcgctagatacta

SEQ ID NO: 335 - DNA, 14 bp, synthetic construct
  source 1..14: mol_type = other DNA
atctcgcttagacc

SEQ ID NO: 336 - DNA, 14 bp, synthetic construct
  source 1..14: mol_type = other DNA
cgtctcgtcgggct

SEQ ID NO: 337 - DNA, 14 bp, synthetic construct
  source 1..14: mol_type = other DNA
cattcagcgcagtt

SEQ ID NO: 338 - DNA, 14 bp, synthetic construct
  source 1..14: mol_type = other DNA
tggcggttgtgcac

SEQ ID NO: 339 - DNA, 14 bp, synthetic construct
  source 1..14: mol_type = other DNA
ataggtgtcataaa

SEQ ID NO: 340 - DNA, 14 bp, synthetic construct
  source 1..14: mol_type = other DNA
accgtctcaagttg

SEQ ID NO: 341 - DNA, 14 bp, synthetic construct
  source 1..14: mol_type = other DNA
aaagtcctttcgag

SEQ ID NO: 342 - DNA, 14 bp, synthetic construct
  source 1..14: mol_type = other DNA
cgcctatatggttc

SEQ ID NO: 343 - DNA, 14 bp, synthetic construct
  source 1..14: mol_type = other DNA
agtcttcgccattc

SEQ ID NO: 344 - DNA, 14 bp, synthetic construct
  source 1..14: mol_type = other DNA
ttagactagaatct

SEQ ID NO: 345 - DNA, 14 bp, synthetic construct
  source 1..14: mol_type = other DNA
tggagccttaactt

SEQ ID NO: 346 - DNA, 14 bp, synthetic construct
  source 1..14: mol_type = other DNA
tccggctgtcatat

SEQ ID NO: 347 - DNA, 14 bp, synthetic construct
  source 1..14: mol_type = other DNA
acgttattgtccga

SEQ ID NO: 348 - DNA, 14 bp, synthetic construct
  source 1..14: mol_type = other DNA
tctgtccaacatat

SEQ ID NO: 349 - DNA, 14 bp, synthetic construct
  source 1..14: mol_type = other DNA
tgacatcatttagc

SEQ ID NO: 350 - DNA, 14 bp, synthetic construct
  source 1..14: mol_type = other DNA
tgatttccgctaaa

SEQ ID NO: 351 - DNA, 14 bp, synthetic construct
  source 1..14: mol_type = other DNA
ttattcgtaagcgc

SEQ ID NO: 352 - DNA, 14 bp, synthetic construct
  source 1..14: mol_type = other DNA
tttcaaactgacct

SEQ ID NO: 353 - DNA, 14 bp, synthetic construct
  source 1..14: mol_type = other DNA
tgtaactaattgcg

SEQ ID NO: 354 - DNA, 14 bp, synthetic construct
  source 1..14: mol_type = other DNA
tcacttttggccgc

SEQ ID NO: 355 - DNA, 14 bp, synthetic construct
  source 1..14: mol_type = other DNA
tggttctgaccggt

SEQ ID NO: 356 - DNA, 14 bp, synthetic construct
  source 1..14: mol_type = other DNA
acgtgatcttggat

SEQ ID NO: 357 - DNA, 14 bp, synthetic construct
  source 1..14: mol_type = other DNA
gcttgttcctaacg

SEQ ID NO: 358 - DNA, 14 bp, synthetic construct
  source 1..14: mol_type = other DNA
cttactatagggct

SEQ ID NO: 359 - DNA, 14 bp, synthetic construct
  source 1..14: mol_type = other DNA
ttaagggatagtta

SEQ ID NO: 360 - DNA, 14 bp, synthetic construct
  source 1..14: mol_type = other DNA
ggcttcttcgcaat

SEQ ID NO: 361 - DNA, 14 bp, synthetic construct
  source 1..14: mol_type = other DNA
atcatgcttgagta

SEQ ID NO: 362 - DNA, 14 bp, synthetic construct
  source 1..14: mol_type = other DNA
atcgtctctatcaa

SEQ ID NO: 363 - DNA, 14 bp, synthetic construct
  source 1..14: mol_type = other DNA
tttgacttccaaga

SEQ ID NO: 364 - DNA, 14 bp, synthetic construct
  source 1..14: mol_type = other DNA
tgtggcctgttgcc

SEQ ID NO: 365 - DNA, 14 bp, synthetic construct
  source 1..14: mol_type = other DNA
ttgcctaggatggt

SEQ ID NO: 366 - DNA, 14 bp, synthetic construct
  source 1..14: mol_type = other DNA
tgtcgtgacttaac

SEQ ID NO: 367 - DNA, 14 bp, synthetic construct
  source 1..14: mol_type = other DNA
atcttagtaactga

SEQ ID NO: 368 - DNA, 14 bp, synthetic construct
  source 1..14: mol_type = other DNA
ccctttctacgtga

SEQ ID NO: 369 - DNA, 14 bp, synthetic construct
  source 1..14: mol_type = other DNA
ctatgatacagctt

SEQ ID NO: 370 - DNA, 14 bp, synthetic construct
  source 1..14: mol_type = other DNA
ctgtttgggccgct

SEQ ID NO: 371 - DNA, 14 bp, synthetic construct
  source 1..14: mol_type = other DNA
cggtcatgtccttc

SEQ ID NO: 372 - DNA, 14 bp, synthetic construct
  source 1..14: mol_type = other DNA
cgatactgttacat

SEQ ID NO: 373 - DNA, 14 bp, synthetic construct
  source 1..14: mol_type = other DNA
gcttcctcacttcc

SEQ ID NO: 374 - DNA, 14 bp, synthetic construct
  source 1..14: mol_type = other DNA
cttggatgcttgac

SEQ ID NO: 375 - DNA, 14 bp, synthetic construct
  source 1..14: mol_type = other DNA
ttccttccggctct

SEQ ID NO: 376 - DNA, 14 bp, synthetic construct
  source 1..14: mol_type = other DNA
tcgcgtgatgttgt

SEQ ID NO: 377 - DNA, 14 bp, synthetic construct
  source 1..14: mol_type = other DNA
aagcgttacatttt

SEQ ID NO: 378 - DNA, 14 bp, synthetic construct
  source 1..14: mol_type = other DNA
ttttccgactgtac

SEQ ID NO: 379 - DNA, 14 bp, synthetic construct
  source 1..14: mol_type = other DNA
agtttcctgcgtgt

SEQ ID NO: 380 - DNA, 14 bp, synthetic construct
  source 1..14: mol_type = other DNA
tacagtactatttg

SEQ ID NO: 381 - DNA, 14 bp, synthetic construct
  source 1..14: mol_type = other DNA
gtctgattgggtgt

SEQ ID NO: 382 - DNA, 14 bp, synthetic construct
  source 1..14: mol_type = other DNA
cgaacttttctgct

SEQ ID NO: 383 - DNA, 14 bp, synthetic construct
  source 1..14: mol_type = other DNA
gaatatgtgtagtt

SEQ ID NO: 384 - DNA, 14 bp, synthetic construct
  source 1..14: mol_type = other DNA
ggttgcctttctcg

SEQ ID NO: 385 - DNA, 14 bp, synthetic construct
  source 1..14: mol_type = other DNA
gactgattttgatt

SEQ ID NO: 386 - DNA, 14 bp, synthetic construct
  source 1..14: mol_type = other DNA
tttggatttggtct

SEQ ID NO: 387 - DNA, 14 bp, synthetic construct
  source 1..14: mol_type = other DNA
cttattttgcattg

SEQ ID NO: 388 - DNA, 14 bp, synthetic construct
  source 1..14: mol_type = other DNA
ctcttgacattttt

SEQ ID NO: 389 - DNA, 14 bp, synthetic construct
  source 1..14: mol_type = other DNA
catttacctatttt

SEQ ID NO: 390 - DNA, 14 bp, synthetic construct
  source 1..14: mol_type = other DNA
tttgaatagttgtt

SEQ ID NO: 391 - DNA, 14 bp, synthetic construct
  source 1..14: mol_type = other DNA
tggtttatgaattt

SEQ ID NO: 392 - DNA, 14 bp, synthetic construct
  source 1..14: mol_type = other DNA
tatttgttctctac

SEQ ID NO: 393 - DNA, 14 bp, synthetic construct
  source 1..14: mol_type = other DNA
ttttgatacttctg

SEQ ID NO: 394 - DNA, 14 bp, synthetic construct
  source 1..14: mol_type = other DNA
gtacatttttctgt

SEQ ID NO: 395 - DNA, 14 bp, synthetic construct
  source 1..14: mol_type = other DNA
ttggtttttgactg

SEQ ID NO: 396 - DNA, 14 bp, synthetic construct
  source 1..14: mol_type = other DNA
ctctttcgtttcct

SEQ ID NO: 397 - DNA, 14 bp, synthetic construct
  source 1..14: mol_type = other DNA
ttttatgctcttat

SEQ ID NO: 398 - DNA, 14 bp, synthetic construct
  source 1..14: mol_type = other DNA
cgtcattctttttt

SEQ ID NO: 399 - DNA, 14 bp, synthetic construct
  source 1..14: mol_type = other DNA
gccgcaacacccga

SEQ ID NO: 400 - DNA, 14 bp, synthetic construct
  source 1..14: mol_type = other DNA
gcggagccagagac

SEQ ID NO: 401 - DNA, 14 bp, synthetic construct
  source 1..14: mol_type = other DNA
gaaccaaaacgcgc

SEQ ID NO: 402 - DNA, 14 bp, synthetic construct
  source 1..14: mol_type = other DNA
cgaacaccagcccc

SEQ ID NO: 403 - DNA, 14 bp, synthetic construct
  source 1..14: mol_type = other DNA
gggaaccccacgcg

SEQ ID NO: 404 - DNA, 14 bp, synthetic construct
  source 1..14: mol_type = other DNA
aacgccagcgaccc

SEQ ID NO: 405 - DNA, 14 bp, synthetic construct
  source 1..14: mol_type = other DNA
ccagaaaggagaga

SEQ ID NO: 406 - DNA, 14 bp, synthetic construct
  source 1..14: mol_type = other DNA
acccacggcgagga

SEQ ID NO: 407 - DNA, 14 bp, synthetic construct
  source 1..14: mol_type = other DNA
acacaacaagagga

SEQ ID NO: 408 - DNA, 14 bp, synthetic construct
  source 1..14: mol_type = other DNA
acacccagcgcaga

SEQ ID NO: 409 - DNA, 14 bp, synthetic construct
  source 1..14: mol_type = other DNA
ggagaccgccaacg

SEQ ID NO: 410 - DNA, 14 bp, synthetic construct
  source 1..14: mol_type = other DNA
gcagggaccccacg

SEQ ID NO: 411 - DNA, 14 bp, synthetic construct
  source 1..14: mol_type = other DNA
ggaccgcaaaagcc

SEQ ID NO: 412 - DNA, 14 bp, synthetic construct
  source 1..14: mol_type = other DNA
agccaagcggggga

SEQ ID NO: 413 - DNA, 14 bp, synthetic construct
  source 1..14: mol_type = other DNA
aacaccacgcgaac

SEQ ID NO: 414 - DNA, 14 bp, synthetic construct
  source 1..14: mol_type = other DNA
cgcacaggcggaga

SEQ ID NO: 415 - DNA, 14 bp, synthetic construct
  source 1..14: mol_type = other DNA
agaccggacggaga

SEQ ID NO: 416 - DNA, 14 bp, synthetic construct
  source 1..14: mol_type = other DNA
cgcagagaagagaa

SEQ ID NO: 417 - DNA, 14 bp, synthetic construct
  source 1..14: mol_type = other DNA
gcgggaagacagcg

SEQ ID NO: 418 - DNA, 14 bp, synthetic construct
  source 1..14: mol_type = other DNA
gaaagagggggcgg

SEQ ID NO: 419 - DNA, 14 bp, synthetic construct
  source 1..14: mol_type = other DNA
caaagaccgcgcca

SEQ ID NO: 420 - DNA, 14 bp, synthetic construct
  source 1..14: mol_type = other DNA
aggcaacagagggc

SEQ ID NO: 421 - DNA, 14 bp, synthetic construct
  source 1..14: mol_type = other DNA
ggaacaacgcccaa

SEQ ID NO: 422 - DNA, 14 bp, synthetic construct
  source 1..14: mol_type = other DNA
cgccagcacccacg

SEQ ID NO: 423 - DNA, 14 bp, synthetic construct
  source 1..14: mol_type = other DNA
aaagcggcgccggc

SEQ ID NO: 424 - DNA, 14 bp, synthetic construct
  source 1..14: mol_type = other DNA
cggaggggaagccg

SEQ ID NO: 425 - DNA, 14 bp, synthetic construct
  source 1..14: mol_type = other DNA
aaaaagaacaaggc

SEQ ID NO: 426 - DNA, 14 bp, synthetic construct
  source 1..14: mol_type = other DNA
gggacaagaagcga

SEQ ID NO: 427 - DNA, 14 bp, synthetic construct
  source 1..14: mol_type = other DNA
cgaggccaaaacaa

SEQ ID NO: 428 - DNA, 14 bp, synthetic construct
  source 1..14: mol_type = other DNA
aacacgctccggga

SEQ ID NO: 429 - DNA, 14 bp, synthetic construct
  source 1..14: mol_type = other DNA
tcaggggcaagccc

SEQ ID NO: 430 - DNA, 14 bp, synthetic construct
  source 1..14: mol_type = other DNA
gaggaggtgcccga

SEQ ID NO: 431 - DNA, 14 bp, synthetic construct
  source 1..14: mol_type = other DNA
acgctccacagcga

SEQ ID NO: 432 - DNA, 14 bp, synthetic construct
  source 1..14: mol_type = other DNA
ggccaggcgatcga

SEQ ID NO: 433 - DNA, 14 bp, synthetic construct
  source 1..14: mol_type = other DNA
ggctcggaggaacc

SEQ ID NO: 434 - DNA, 14 bp, synthetic construct
  source 1..14: mol_type = other DNA
ccagagaccggtac

SEQ ID NO: 435 - DNA, 14 bp, synthetic construct
  source 1..14: mol_type = other DNA
ccaacgagggctcg

SEQ ID NO: 436 - DNA, 14 bp, synthetic construct
  source 1..14: mol_type = other DNA
caatccgacagaag

SEQ ID NO: 437 - DNA, 14 bp, synthetic construct
  source 1..14: mol_type = other DNA
acgctcacgccggc

SEQ ID NO: 438 - DNA, 14 bp, synthetic construct
  source 1..14: mol_type = other DNA
cgccgatcggaggc

SEQ ID NO: 439 - DNA, 14 bp, synthetic construct
  source 1..14: mol_type = other DNA
aaataacgcaccgg

SEQ ID NO: 440 - DNA, 14 bp, synthetic construct
  source 1..14: mol_type = other DNA
aggtaaagcgacaa

SEQ ID NO: 441 - DNA, 14 bp, synthetic construct
  source 1..14: mol_type = other DNA
cccgagcctgcagg

SEQ ID NO: 442 - DNA, 14 bp, synthetic construct
  source 1..14: mol_type = other DNA
caggccaccctagc

SEQ ID NO: 443 - DNA, 14 bp, synthetic construct
  source 1..14: mol_type = other DNA
ggcacccggaacct

SEQ ID NO: 444 - DNA, 14 bp, synthetic construct
  source 1..14: mol_type = other DNA
agtgcggagacagc

SEQ ID NO: 445 - DNA, 14 bp, synthetic construct
  source 1..14: mol_type = other DNA
ggggcactcccaac

SEQ ID NO: 446 - DNA, 14 bp, synthetic construct
  source 1..14: mol_type = other DNA
cagctcggacaaga

SEQ ID NO: 447 - DNA, 14 bp, synthetic construct
  source 1..14: mol_type = other DNA
tcacgaaaccgaaa

SEQ ID NO: 448 - DNA, 14 bp, synthetic construct
  source 1..14: mol_type = other DNA
aagctggcaaccaa

SEQ ID NO: 449 - DNA, 14 bp, synthetic construct
  source 1..14: mol_type = other DNA
agcgggtagcgcac

SEQ ID NO: 450 - DNA, 14 bp, synthetic construct
  source 1..14: mol_type = other DNA
accagggtcgggcc

SEQ ID NO: 451 - DNA, 14 bp, synthetic construct
  source 1..14: mol_type = other DNA
ctgccgacgggaga

SEQ ID NO: 452 - DNA, 14 bp, synthetic construct
  source 1..14: mol_type = other DNA
gcgctagaggggcc

SEQ ID NO: 453 - DNA, 14 bp, synthetic construct
  source 1..14: mol_type = other DNA
ggtagggcagcacg

SEQ ID NO: 454 - DNA, 14 bp, synthetic construct
  source 1..14: mol_type = other DNA
gcaacggcatcaca

SEQ ID NO: 455 - DNA, 14 bp, synthetic construct
  source 1..14: mol_type = other DNA
cgagaaagcaagtg

SEQ ID NO: 456 - DNA, 14 bp, synthetic construct
  source 1..14: mol_type = other DNA
agacgcctgcaagg

SEQ ID NO: 457 - DNA, 14 bp, synthetic construct
  source 1..14: mol_type = other DNA
cataaaacgagcgc

SEQ ID NO: 458 - DNA, 14 bp, synthetic construct
  source 1..14: mol_type = other DNA
atgaacaccgacgc

SEQ ID NO: 459 - DNA, 14 bp, synthetic construct
  source 1..14: mol_type = other DNA
cccggtggagaaca

SEQ ID NO: 460 - DNA, 14 bp, synthetic construct
  source 1..14: mol_type = other DNA
tggacagcaacaga

SEQ ID NO: 461 - DNA, 14 bp, synthetic construct
  source 1..14: mol_type = other DNA
atcaccggagaacg

SEQ ID NO: 462 - DNA, 14 bp, synthetic construct
  source 1..14: mol_type = other DNA
cacgcctcggcagc

SEQ ID NO: 463 - DNA, 14 bp, synthetic construct
  source 1..14: mol_type = other DNA
gagcgcaggatcgg

SEQ ID NO: 464 - DNA, 14 bp, synthetic construct
  source 1..14: mol_type = other DNA
agccaccatagaag

SEQ ID NO: 465 - DNA, 14 bp, synthetic construct
  source 1..14: mol_type = other DNA
tcacgccaacacca

SEQ ID NO: 466 - DNA, 14 bp, synthetic construct
  source 1..14: mol_type = other DNA
aaagcgtgcacaac

SEQ ID NO: 467 - DNA, 14 bp, synthetic construct
  source 1..14: mol_type = other DNA
acgagccgatgggc

SEQ ID NO: 468 - DNA, 14 bp, synthetic construct
  source 1..14: mol_type = other DNA
tcccccaaaccagg

SEQ ID NO: 469 - DNA, 14 bp, synthetic construct
  source 1..14: mol_type = other DNA
gtacccggaagacc

SEQ ID NO: 470 - DNA, 14 bp, synthetic construct
  source 1..14: mol_type = other DNA
gcgtgacaaaccag

SEQ ID NO: 471 - DNA, 14 bp, synthetic construct
  source 1..14: mol_type = other DNA
ggaggaatcgaaca

SEQ ID NO: 472 - DNA, 14 bp, synthetic construct
  source 1..14: mol_type = other DNA
aaaacagcgcaact

SEQ ID NO: 473 - DNA, 14 bp, synthetic construct
  source 1..14: mol_type = other DNA
tccagaccggagaa

SEQ ID NO: 474 - DNA, 14 bp, synthetic construct
  source 1..14: mol_type = other DNA
actgcgcacaggag

SEQ ID NO: 475 - DNA, 14 bp, synthetic construct
  source 1..14: mol_type = other DNA
caaaaacctaggac

SEQ ID NO: 476 - DNA, 14 bp, synthetic construct
  source 1..14: mol_type = other DNA
agcaagaatgaacc

SEQ ID NO: 477 - DNA, 14 bp, synthetic construct
  source 1..14: mol_type = other DNA
caaccgcgatcaaa

SEQ ID NO: 478 - DNA, 14 bp, synthetic construct
  source 1..14: mol_type = other DNA
gagggacccctccg

SEQ ID NO: 479 - DNA, 14 bp, synthetic construct
  source 1..14: mol_type = other DNA
cactgcccaaccag

SEQ ID NO: 480 - DNA, 14 bp, synthetic construct
  source 1..14: mol_type = other DNA
cggaacggcgagat

SEQ ID NO: 481 - DNA, 14 bp, synthetic construct
  source 1..14: mol_type = other DNA
aaaagacggcccgt

SEQ ID NO: 482 - DNA, 14 bp, synthetic construct
  source 1..14: mol_type = other DNA
gacatacaggccgc

SEQ ID NO: 483 - DNA, 14 bp, synthetic construct
  source 1..14: mol_type = other DNA
cgacgagataaacc

SEQ ID NO: 484 - DNA, 14 bp, synthetic construct
  source 1..14: mol_type = other DNA
atcacacccgcaga

SEQ ID NO: 485 - DNA, 14 bp, synthetic construct
  source 1..14: mol_type = other DNA
atggaagacggaga

SEQ ID NO: 486 - DNA, 14 bp, synthetic construct
  source 1..14: mol_type = other DNA
ctgcgggagcagac

SEQ ID NO: 487 - DNA, 14 bp, synthetic construct
  source 1..14: mol_type = other DNA
aacaaaagatcaca

SEQ ID NO: 488 - DNA, 14 bp, synthetic construct
  source 1..14: mol_type = other DNA
caacaacacgtacc

SEQ ID NO: 489 - DNA, 14 bp, synthetic construct
  source 1..14: mol_type = other DNA
gggcacaacagcta

SEQ ID NO: 490 - DNA, 14 bp, synthetic construct
  source 1..14: mol_type = other DNA
gcctgcaagcgcca

SEQ ID NO: 491 - DNA, 14 bp, synthetic construct
  source 1..14: mol_type = other DNA
tgggcgagccacag

SEQ ID NO: 492 - DNA, 14 bp, synthetic construct
  source 1..14: mol_type = other DNA
acctgagcccccga

SEQ ID NO: 493 - DNA, 14 bp, synthetic construct
  source 1..14: mol_type = other DNA
aacaggcaggacgt

SEQ ID NO: 494 - DNA, 14 bp, synthetic construct
  source 1..14: mol_type = other DNA
aggcggaatcccgc

SEQ ID NO: 495 - DNA, 14 bp, synthetic construct
  source 1..14: mol_type = other DNA
atccgaggcccccg

SEQ ID NO: 496 - DNA, 14 bp, synthetic construct
  source 1..14: mol_type = other DNA
gcgccatggcgagc

SEQ ID NO: 497 - DNA, 14 bp, synthetic construct
  source 1..14: mol_type = other DNA
cgcgtggaccacga

SEQ ID NO: 498 - DNA, 14 bp, synthetic construct
  source 1..14: mol_type = other DNA
caaactacccacga

SEQ ID NO: 499 - DNA, 14 bp, synthetic construct
  source 1..14: mol_type = other DNA
gcagccgacccact

SEQ ID NO: 500 - DNA, 14 bp, synthetic construct
  source 1..14: mol_type = other DNA
agtggcccacgggg

SEQ ID NO: 501 - DNA, 14 bp, synthetic construct
  source 1..14: mol_type = other DNA
acaaacggagcaat

SEQ ID NO: 502 - DNA, 14 bp, synthetic construct
  source 1..14: mol_type = other DNA
gacactgcgagcga

SEQ ID NO: 503 - DNA, 14 bp, synthetic construct
  source 1..14: mol_type = other DNA
ccacgagcggctgc

SEQ ID NO: 504 - DNA, 14 bp, synthetic construct
  source 1..14: mol_type = other DNA
aggagagcgctcca

SEQ ID NO: 505 - DNA, 14 bp, synthetic construct
  source 1..14: mol_type = other DNA
cagcaagagtaaga

SEQ ID NO: 506 - DNA, 14 bp, synthetic construct
  source 1..14: mol_type = other DNA
gggaagtgccgggc

SEQ ID NO: 507 - DNA, 14 bp, synthetic construct
  source 1..14: mol_type = other DNA
ctcgaaccgacccc

SEQ ID NO: 508 - DNA, 14 bp, synthetic construct
  source 1..14: mol_type = other DNA
ccgtgcaagacagg

SEQ ID NO: 509 - DNA, 14 bp, synthetic construct
  source 1..14: mol_type = other DNA
gcacggataaacca

SEQ ID NO: 510 - DNA, 14 bp, synthetic construct
  source 1..14: mol_type = other DNA
atggcaagaaccac

SEQ ID NO: 511 - DNA, 14 bp, synthetic construct
  source 1..14: mol_type = other DNA
gagcgcctacagcg

SEQ ID NO: 512 - DNA, 14 bp, synthetic construct
  source 1..14: mol_type = other DNA
gctgcccaaccggg

SEQ ID NO: 513 - DNA, 14 bp, synthetic construct
  source 1..14: mol_type = other DNA
gagggagagagtaa

SEQ ID NO: 514 - DNA, 14 bp, synthetic construct
  source 1..14: mol_type = other DNA
ggcagaatagggga

SEQ ID NO: 515 - DNA, 14 bp, synthetic construct
  source 1..14: mol_type = other DNA
gtccaagaacaggc

SEQ ID NO: 516 - DNA, 14 bp, synthetic construct
  source 1..14: mol_type = other DNA
aacaaagcaatgag

SEQ ID NO: 517 - DNA, 14 bp, synthetic construct
  source 1..14: mol_type = other DNA
gccgagtcggaaag

SEQ ID NO: 518 - DNA, 14 bp, synthetic construct
  source 1..14: mol_type = other DNA
acaagaccacagtc

SEQ ID NO: 519 - DNA, 14 bp, synthetic construct
  source 1..14: mol_type = other DNA
tgccggacccgagc

SEQ ID NO: 520 - DNA, 14 bp, synthetic construct
  source 1..14: mol_type = other DNA
ctggaagcaaggca

SEQ ID NO: 521 - DNA, 14 bp, synthetic construct
  source 1..14: mol_type = other DNA
ccaaaacgacgtgc

SEQ ID NO: 522 - DNA, 14 bp, synthetic construct
  source 1..14: mol_type = other DNA
aacgacaatgacga

SEQ ID NO: 523 - DNA, 14 bp, synthetic construct
  source 1..14: mol_type = other DNA
aaacaagcgcacta

SEQ ID NO: 524 - DNA, 14 bp, synthetic construct
  source 1..14: mol_type = other DNA
gaggggtacccaaa

SEQ ID NO: 525 - DNA, 14 bp, synthetic construct
  source 1..14: mol_type = other DNA
ccgacgcacgacta

SEQ ID NO: 526 - DNA, 14 bp, synthetic construct
  source 1..14: mol_type = other DNA
gcaaagatgaggag

SEQ ID NO: 527 - DNA, 14 bp, synthetic construct
  source 1..14: mol_type = other DNA
aaagactaggaaaa

SEQ ID NO: 528 - DNA, 14 bp, synthetic construct
  source 1..14: mol_type = other DNA
tgaccagagggcgc

SEQ ID NO: 529 - DNA, 14 bp, synthetic construct
  source 1..14: mol_type = other DNA
tcgcaggggaaaga

SEQ ID NO: 530 - DNA, 14 bp, synthetic construct
  source 1..14: mol_type = other DNA
cgatggaggaaaag

SEQ ID NO: 531 - DNA, 14 bp, synthetic construct
  source 1..14: mol_type = other DNA
gacctcccagcgac

SEQ ID NO: 532 - DNA, 14 bp, synthetic construct
  source 1..14: mol_type = other DNA
agcaataacaggga

SEQ ID NO: 533 - DNA, 14 bp, synthetic construct
  source 1..14: mol_type = other DNA
caccggaggtcacc

SEQ ID NO: 534 - DNA, 14 bp, synthetic construct
  source 1..14: mol_type = other DNA
gaagactgaacacc

SEQ ID NO: 535 - DNA, 14 bp, synthetic construct
  source 1..14: mol_type = other DNA
ggaaatcgcaggac

SEQ ID NO: 536 - DNA, 14 bp, synthetic construct
  source 1..14: mol_type = other DNA
aaaaacaaggactg

SEQ ID NO: 537 - DNA, 14 bp, synthetic construct
  source 1..14: mol_type = other DNA
ggcggtgcaaccca

SEQ ID NO: 538 - DNA, 14 bp, synthetic construct
  source 1..14: mol_type = other DNA
ggtgccacgacacg

SEQ ID NO: 539 - DNA, 14 bp, synthetic construct
  source 1..14: mol_type = other DNA
acccagtggacacc

SEQ ID NO: 540 - DNA, 14 bp, synthetic construct
  source 1..14: mol_type = other DNA
gcagcataaaacag

SEQ ID NO: 541 - DNA, 14 bp, synthetic construct
  source 1..14: mol_type = other DNA
gcagcgagaaacgt

SEQ ID NO: 542 - DNA, 14 bp, synthetic construct
  source 1..14: mol_type = other DNA
agcgacatcaaaac

SEQ ID NO: 543 - DNA, 14 bp, synthetic construct
  source 1..14: mol_type = other DNA
caagatgcaggaaa

SEQ ID NO: 544 - DNA, 14 bp, synthetic construct
  source 1..14: mol_type = other DNA
gcgaccagcaagta

SEQ ID NO: 545 - DNA, 14 bp, synthetic construct
  source 1..14: mol_type = other DNA
aaaacctacgaagg

SEQ ID NO: 546 - DNA, 14 bp, synthetic construct
  source 1..14: mol_type = other DNA
aaaggatgaaagcc

SEQ ID NO: 547 - DNA, 14 bp, synthetic construct
  source 1..14: mol_type = other DNA
tcgagggcacgcgg

SEQ ID NO: 548 - DNA, 14 bp, synthetic construct
  source 1..14: mol_type = other DNA
ccacagactcccac

SEQ ID NO: 549 - DNA, 14 bp, synthetic construct
  source 1..14: mol_type = other DNA
cacgagcgaaagtg

SEQ ID NO: 550 - DNA, 14 bp, synthetic construct
  source 1..14: mol_type = other DNA
accggagggagcta

SEQ ID NO: 551 - DNA, 14 bp, synthetic construct
  source 1..14: mol_type = other DNA
ggacgtccggcaag

SEQ ID NO: 552 - DNA, 14 bp, synthetic construct
  source 1..14: mol_type = other DNA
agcacacgctggca

SEQ ID NO: 553 - DNA, 14 bp, synthetic construct
  source 1..14: mol_type = other DNA
taaacggcgggccg

SEQ ID NO: 554 - DNA, 14 bp, synthetic construct
  source 1..14: mol_type = other DNA
gcgatggagcccgg

SEQ ID NO: 555 - DNA, 14 bp, synthetic construct
  source 1..14: mol_type = other DNA
cgtcaagaaacgcc

SEQ ID NO: 556 - DNA, 14 bp, synthetic construct
  source 1..14: mol_type = other DNA
gcataccagaaacg

SEQ ID NO: 557 - DNA, 14 bp, synthetic construct
  source 1..14: mol_type = other DNA
accggtatgcgaga

SEQ ID NO: 558 - DNA, 14 bp, synthetic construct
  source 1..14: mol_type = other DNA
agtcacccctaaca

SEQ ID NO: 559 - DNA, 14 bp, synthetic construct
  source 1..14: mol_type = other DNA
acgaaaacccatta

SEQ ID NO: 560 - DNA, 14 bp, synthetic construct
  source 1..14: mol_type = other DNA
ctacctgaagaaca

SEQ ID NO: 561 - DNA, 14 bp, synthetic construct
  source 1..14: mol_type = other DNA
gcaagtcgcgatcc

SEQ ID NO: 562 - DNA, 14 bp, synthetic construct
  source 1..14: mol_type = other DNA
tggcaccgaaatag

SEQ ID NO: 563 - DNA, 14 bp, synthetic construct
  source 1..14: mol_type = other DNA
ccctcgtggggaca

SEQ ID NO: 564 - DNA, 14 bp, synthetic construct
  source 1..14: mol_type = other DNA
ggatctgcaacacg

SEQ ID NO: 565 - DNA, 14 bp, synthetic construct
  source 1..14: mol_type = other DNA
gtggaccataacag

SEQ ID NO: 566 - DNA, 14 bp, synthetic construct
  source 1..14: mol_type = other DNA
cggctgccaaggct

SEQ ID NO: 567 - DNA, 14 bp, synthetic construct
  source 1..14: mol_type = other DNA
cgactcatacaaca

SEQ ID NO: 568 - DNA, 14 bp, synthetic construct
  source 1..14: mol_type = other DNA
gtaagctagggaag

SEQ ID NO: 569 - DNA, 14 bp, synthetic construct
  source 1..14: mol_type = other DNA
acgaacggagttcg

SEQ ID NO: 570 - DNA, 14 bp, synthetic construct
  source 1..14: mol_type = other DNA
acactgggacgagt

SEQ ID NO: 571 - DNA, 14 bp, synthetic construct
  source 1..14: mol_type = other DNA
agcatgatgccgcc

SEQ ID NO: 572 - DNA, 14 bp, synthetic construct
  source 1..14: mol_type = other DNA
gatccagccgggtg

SEQ ID NO: 573 - DNA, 14 bp, synthetic construct
  source 1..14: mol_type = other DNA
gtcgactcaaggga

SEQ ID NO: 574 - DNA, 14 bp, synthetic construct
  source 1..14: mol_type = other DNA
aaagagacccgatt

SEQ ID NO: 575 - DNA, 14 bp, synthetic construct
  source 1..14: mol_type = other DNA
ggcagctctgaagc

SEQ ID NO: 576 - DNA, 14 bp, synthetic construct
  source 1..14: mol_type = other DNA
ccggtctcagcaca

SEQ ID NO: 577 - DNA, 14 bp, synthetic construct
  source 1..14: mol_type = other DNA
gacaggatcagtcc

SEQ ID NO: 578 - DNA, 14 bp, synthetic construct
  source 1..14: mol_type = other DNA
ccgatcgaaatacg

SEQ ID NO: 579 - DNA, 14 bp, synthetic construct
  source 1..14: mol_type = other DNA
gccggtcgatccaa

SEQ ID NO: 580 - DNA, 14 bp, synthetic construct
  source 1..14: mol_type = other DNA
gaccagctcctgac

SEQ ID NO: 581 - DNA, 14 bp, synthetic construct
  source 1..14: mol_type = other DNA
attaagagaacgag

SEQ ID NO: 582 - DNA, 14 bp, synthetic construct
  source 1..14: mol_type = other DNA
cgtacaaggatggc

SEQ ID NO: 583 - DNA, 14 bp, synthetic construct
  source 1..14: mol_type = other DNA
tagtcgccagccaa

SEQ ID NO: 584 - DNA, 14 bp, synthetic construct
  source 1..14: mol_type = other DNA
gcccaagtgataca

SEQ ID NO: 585 - DNA, 14 bp, synthetic construct
  source 1..14: mol_type = other DNA
gaacgcggtgtaag

SEQ ID NO: 586 - DNA, 14 bp, synthetic construct
  source 1..14: mol_type = other DNA
ggctaataaaaaac

SEQ ID NO: 587 - DNA, 14 bp, synthetic construct
  source 1..14: mol_type = other DNA
cagacggcacctta

SEQ ID NO: 588 - DNA, 14 bp, synthetic construct
  source 1..14: mol_type = other DNA
aacggcgttgacac

SEQ ID NO: 589 - DNA, 14 bp, synthetic construct
  source 1..14: mol_type = other DNA
ccatatggaggcgc

SEQ ID NO: 590 - DNA, 14 bp, synthetic construct
  source 1..14: mol_type = other DNA
gtaagtacaaggag

SEQ ID NO: 591 - DNA, 14 bp, synthetic construct
  source 1..14: mol_type = other DNA
gatgcgacccgtcc

SEQ ID NO: 592 - DNA, 14 bp, synthetic construct
  source 1..14: mol_type = other DNA
gctgggtaggccgg

SEQ ID NO: 593 - DNA, 14 bp, synthetic construct
  source 1..14: mol_type = other DNA
atcccctccgggga

SEQ ID NO: 594 - DNA, 14 bp, synthetic construct
  source 1..14: mol_type = other DNA
tagccctcacgccg

SEQ ID NO: 595 - DNA, 14 bp, synthetic construct
  source 1..14: mol_type = other DNA
tgcgcgagagaatg

SEQ ID NO: 596 - DNA, 14 bp, synthetic construct
  source 1..14: mol_type = other DNA
cgatcgaaaactca

SEQ ID NO: 597 - DNA, 14 bp, synthetic construct
  source 1..14: mol_type = other DNA
gacacaccagcgtt

SEQ ID NO: 598 - DNA, 14 bp, synthetic construct
  source 1..14: mol_type = other DNA
gaaccaccaagttg

SEQ ID NO: 599 - DNA, 14 bp, synthetic construct
  source 1..14: mol_type = other DNA
cgcagcgcgtcatc

SEQ ID NO: 600 - DNA, 14 bp, synthetic construct
  source 1..14: mol_type = other DNA
agaaagcacgtcta

SEQ ID NO: 601 - DNA, 14 bp, synthetic construct
  source 1..14: mol_type = other DNA
taggacacgggcta

SEQ ID NO: 602 - DNA, 14 bp, synthetic construct
  source 1..14: mol_type = other DNA
ctgagacctggaga

SEQ ID NO: 603 - DNA, 14 bp, synthetic construct
  source 1..14: mol_type = other DNA
aaagataagatgcc

SEQ ID NO: 604 - DNA, 14 bp, synthetic construct
  source 1..14: mol_type = other DNA
aaacaatcataggg

SEQ ID NO: 605 - DNA, 14 bp, synthetic construct
  source 1..14: mol_type = other DNA
gagagggtgtcacc

SEQ ID NO: 606 - DNA, 14 bp, synthetic construct
  source 1..14: mol_type = other DNA
ctcagtggacgcgc

SEQ ID NO: 607 - DNA, 14 bp, synthetic construct
  source 1..14: mol_type = other DNA
ccttaggcgaacca

SEQ ID NO: 608 - DNA, 14 bp, synthetic construct
  source 1..14: mol_type = other DNA
gcccctagacaatg

SEQ ID NO: 609 - DNA, 14 bp, synthetic construct
  source 1..14: mol_type = other DNA
aagggaaaactatc

SEQ ID NO: 610 - DNA, 14 bp, synthetic construct
  source 1..14: mol_type = other DNA
ggtataccgacccc

SEQ ID NO: 611 - DNA, 14 bp, synthetic construct
  source 1..14: mol_type = other DNA
taccctagcagaaa

SEQ ID NO: 612 - DNA, 14 bp, synthetic construct
  source 1..14: mol_type = other DNA
gctgaccacggcta

SEQ ID NO: 613 - DNA, 14 bp, synthetic construct
  source 1..14: mol_type = other DNA
tgcggcaaacgggt

SEQ ID NO: 614 - DNA, 14 bp, synthetic construct
  source 1..14: mol_type = other DNA
gcgtggcacgtccc

SEQ ID NO: 615 - DNA, 14 bp, synthetic construct
  source 1..14: mol_type = other DNA
cgaacgctgcgcta

SEQ ID NO: 616 - DNA, 14 bp, synthetic construct
  source 1..14: mol_type = other DNA
ggtagcggcacact

SEQ ID NO: 617 - DNA, 14 bp, synthetic construct
  source 1..14: mol_type = other DNA
ttagccgcaaagcc

SEQ ID NO: 618 - DNA, 14 bp, synthetic construct
  source 1..14: mol_type = other DNA
cggccatatgagac

SEQ ID NO: 619 - DNA, 14 bp, synthetic construct
  source 1..14: mol_type = other DNA
ggtcggcctaccca

SEQ ID NO: 620 - DNA, 14 bp, synthetic construct
  source 1..14: mol_type = other DNA
catccatcccccag

SEQ ID NO: 621 - DNA, 14 bp, synthetic construct
  source 1..14: mol_type = other DNA
gccggatcgaccat

SEQ ID NO: 622 - DNA, 14 bp, synthetic construct
  source 1..14: mol_type = other DNA
accccaggctgact

SEQ ID NO: 623 - DNA, 14 bp, synthetic construct
  source 1..14: mol_type = other DNA
agaggggaatctcc

SEQ ID NO: 624 - DNA, 14 bp, synthetic construct
  source 1..14: mol_type = other DNA
caatgtgaggaaag

SEQ ID NO: 625 - DNA, 14 bp, synthetic construct
  source 1..14: mol_type = other DNA
ctgcagtcgcaccg

SEQ ID NO: 626 - DNA, 14 bp, synthetic construct
  source 1..14: mol_type = other DNA
agtaataaaagcag

SEQ ID NO: 627 - DNA, 14 bp, synthetic construct
  source 1..14: mol_type = other DNA
accacgccgtctga

SEQ ID NO: 628 - DNA, 14 bp, synthetic construct
  source 1..14: mol_type = other DNA
aagctcaaggtagc

SEQ ID NO: 629 - DNA, 14 bp, synthetic construct
  source 1..14: mol_type = other DNA
ggtcgaaatgacga

SEQ ID NO: 630 - DNA, 14 bp, synthetic construct
  source 1..14: mol_type = other DNA
ataggcagacatgg

SEQ ID NO: 631 - DNA, 14 bp, synthetic construct
  source 1..14: mol_type = other DNA
tggcatacccccca

SEQ ID NO: 632 - DNA, 14 bp, synthetic construct
  source 1..14: mol_type = other DNA
agccactacgctgc

SEQ ID NO: 633 - DNA, 14 bp, synthetic construct
  source 1..14: mol_type = other DNA
agccccaagtggta

SEQ ID NO: 634 - DNA, 14 bp, synthetic construct
  source 1..14: mol_type = other DNA
taggacgtgcgacg

SEQ ID NO: 635 - DNA, 14 bp, synthetic construct
  source 1..14: mol_type = other DNA
ctaagaatccgcgc

SEQ ID NO: 636 - DNA, 14 bp, synthetic construct
  source 1..14: mol_type = other DNA
cttcgaaccaccga

SEQ ID NO: 637 - DNA, 14 bp, synthetic construct
  source 1..14: mol_type = other DNA
gtcactaccccgag

SEQ ID NO: 638 - DNA, 14 bp, synthetic construct
  source 1..14: mol_type = other DNA
gcaggaagctgggt

SEQ ID NO: 639 - DNA, 14 bp, synthetic construct
  source 1..14: mol_type = other DNA
aatacggccataga

SEQ ID NO: 640 - DNA, 14 bp, synthetic construct
  source 1..14: mol_type = other DNA
tcaggcctcgcgcc

SEQ ID NO: 641 - DNA, 14 bp, synthetic construct
  source 1..14: mol_type = other DNA
ggcctcaagcgtgg

SEQ ID NO: 642 - DNA, 14 bp, synthetic construct
  source 1..14: mol_type = other DNA
tcccgcatcgaaag

SEQ ID NO: 643 - DNA, 14 bp, synthetic construct
  source 1..14: mol_type = other DNA
gagtgtgacccacc

SEQ ID NO: 644 - DNA, 14 bp, synthetic construct
  source 1..14: mol_type = other DNA
gcctgcataacgac

SEQ ID NO: 645 - DNA, 14 bp, synthetic construct
  source 1..14: mol_type = other DNA
aaggaccctgatac

SEQ ID NO: 646 - DNA, 14 bp, synthetic construct
  source 1..14: mol_type = other DNA
gatagtcgaaaaga

SEQ ID NO: 647 - DNA, 14 bp, synthetic construct
  source 1..14: mol_type = other DNA
gcgggtcaactcgc

SEQ ID NO: 648 - DNA, 14 bp, synthetic construct
  source 1..14: mol_type = other DNA
cgttgagcacacag

SEQ ID NO: 649 - DNA, 14 bp, synthetic construct
  source 1..14: mol_type = other DNA
agtcgcgaggacgt

SEQ ID NO: 650 - DNA, 14 bp, synthetic construct
  source 1..14: mol_type = other DNA
caggacaaggttgg

SEQ ID NO: 651 - DNA, 14 bp, synthetic construct
  source 1..14: mol_type = other DNA
acgacggctgatca

SEQ ID NO: 652 - DNA, 14 bp, synthetic construct
  source 1..14: mol_type = other DNA
aaatcatgacaaca

SEQ ID NO: 653 - DNA, 14 bp, synthetic construct
  source 1..14: mol_type = other DNA
cggcgtacaagcgt

SEQ ID NO: 654 - DNA, 14 bp, synthetic construct
  source 1..14: mol_type = other DNA
gttcgggagacaaa

SEQ ID NO: 655 - DNA, 14 bp, synthetic construct
  source 1..14: mol_type = other DNA
ctcgtcagaaggca

SEQ ID NO: 656 - DNA, 14 bp, synthetic construct
  source 1..14: mol_type = other DNA
acgatgagcgtgca

SEQ ID NO: 657 - DNA, 14 bp, synthetic construct
  source 1..14: mol_type = other DNA
gggaccacgtgtgc

SEQ ID NO: 658 - DNA, 14 bp, synthetic construct
  source 1..14: mol_type = other DNA
tacagtgacagacg

SEQ ID NO: 659 - DNA, 14 bp, synthetic construct
  source 1..14: mol_type = other DNA
taaaggacgcgagt

SEQ ID NO: 660 - DNA, 14 bp, synthetic construct
  source 1..14: mol_type = other DNA
gttgaaggaacaac

SEQ ID NO: 661 - DNA, 14 bp, synthetic construct
  source 1..14: mol_type = other DNA
cgaactggatcgaa

SEQ ID NO: 662 - DNA, 14 bp, synthetic construct
  source 1..14: mol_type = other DNA
aagttccacccaga

SEQ ID NO: 663 - DNA, 14 bp, synthetic construct
  source 1..14: mol_type = other DNA
cctagggaaacact

SEQ ID NO: 664 - DNA, 14 bp, synthetic construct
  source 1..14: mol_type = other DNA
aacaatcatgggca

SEQ ID NO: 665 - DNA, 14 bp, synthetic construct
  source 1..14: mol_type = other DNA
cggctgtaggcaga

SEQ ID NO: 666 - DNA, 14 bp, synthetic construct
  source 1..14: mol_type = other DNA
gcacgtcaccggta

SEQ ID NO: 667 - DNA, 14 bp, synthetic construct
  source 1..14: mol_type = other DNA
tagcggagggatgc

SEQ ID NO: 668 - DNA, 14 bp, synthetic construct
  source 1..14: mol_type = other DNA
gaacccacctcctg

SEQ ID NO: 669 - DNA, 14 bp, synthetic construct
  source 1..14: mol_type = other DNA
ccaagatgaaacta

SEQ ID NO: 670 - DNA, 14 bp, synthetic construct
  source 1..14: mol_type = other DNA
tccgtgcgccaaca

SEQ ID NO: 671 - DNA, 14 bp, synthetic construct
  source 1..14: mol_type = other DNA
gacagcgaggttag

SEQ ID NO: 672 - DNA, 14 bp, synthetic construct
  source 1..14: mol_type = other DNA
gagatgaggaatcc

SEQ ID NO: 673 - DNA, 14 bp, synthetic construct
  source 1..14: mol_type = other DNA
gccaccgcgtacat

SEQ ID NO: 674 - DNA, 14 bp, synthetic construct
  source 1..14: mol_type = other DNA
ctgacacgccgtcg

SEQ ID NO: 675 - DNA, 14 bp, synthetic construct
  source 1..14: mol_type = other DNA
ccactagaactacc

SEQ ID NO: 676 - DNA, 14 bp, synthetic construct
  source 1..14: mol_type = other DNA
cccataaataagac

SEQ ID NO: 677 - DNA, 14 bp, synthetic construct
  source 1..14: mol_type = other DNA
aatcccgagcgagt

SEQ ID NO: 678 - DNA, 14 bp, synthetic construct
  source 1..14: mol_type = other DNA
ttcggacccaagag

SEQ ID NO: 679 - DNA, 14 bp, synthetic construct
  source 1..14: mol_type = other DNA
ctaggggcacacta

SEQ ID NO: 680 - DNA, 14 bp, synthetic construct
  source 1..14: mol_type = other DNA
acgtccgtgcaacc

SEQ ID NO: 681 - DNA, 14 bp, synthetic construct
  source 1..14: mol_type = other DNA
atggcgcaggggat

SEQ ID NO: 682 - DNA, 14 bp, synthetic construct
  source 1..14: mol_type = other DNA
gagccgtatcgaga

SEQ ID NO: 683 - DNA, 14 bp, synthetic construct
  source 1..14: mol_type = other DNA
aacctgggaatcgg

SEQ ID NO: 684 - DNA, 14 bp, synthetic construct
  source 1..14: mol_type = other DNA
acccgacttgacgg

SEQ ID NO: 685 - DNA, 14 bp, synthetic construct
  source 1..14: mol_type = other DNA
acgattaggcggcc

SEQ ID NO: 686 - DNA, 14 bp, synthetic construct
  source 1..14: mol_type = other DNA
ctcggcacacaatc

SEQ ID NO: 687 - DNA, 14 bp, synthetic construct
  source 1..14: mol_type = other DNA
agaaccgtcctcgc

SEQ ID NO: 688 - DNA, 14 bp, synthetic construct
  source 1..14: mol_type = other DNA
acaacgtgcatcga

SEQ ID NO: 689 - DNA, 14 bp, synthetic construct
  source 1..14: mol_type = other DNA
tacagcgcaggctc

SEQ ID NO: 690 - DNA, 14 bp, synthetic construct
  source 1..14: mol_type = other DNA
cgggtaaggaatac

SEQ ID NO: 691 - DNA, 14 bp, synthetic construct
  source 1..14: mol_type = other DNA
attacggaaagggc

SEQ ID NO: 692 - DNA, 14 bp, synthetic construct
  source 1..14: mol_type = other DNA
cagatgatggcaca

SEQ ID NO: 693 - DNA, 14 bp, synthetic construct
  source 1..14: mol_type = other DNA
gcaaaggcggttgc

SEQ ID NO: 694 - DNA, 14 bp, synthetic construct
  source 1..14: mol_type = other DNA
tacaggaaagtggg

SEQ ID NO: 695 - DNA, 14 bp, synthetic construct
  source 1..14: mol_type = other DNA
ctctggaagcgagg

SEQ ID NO: 696 - DNA, 14 bp, synthetic construct
  source 1..14: mol_type = other DNA
cgagtaggagccct

SEQ ID NO: 697 - DNA, 14 bp, synthetic construct
  source 1..14: mol_type = other DNA
tccaccaggctcca

SEQ ID NO: 698 - DNA, 14 bp, synthetic construct
  source 1..14: mol_type = other DNA
tctacaaaacaaaa

SEQ ID NO: 699 - DNA, 14 bp, synthetic construct
  source 1..14: mol_type = other DNA
caccaacagatcta

SEQ ID NO: 700 - DNA, 14 bp, synthetic construct
  source 1..14: mol_type = other DNA
gcagtgatgccgca

SEQ ID NO: 701 - DNA, 14 bp, synthetic construct
  source 1..14: mol_type = other DNA
gggcgttgcacaca

SEQ ID NO: 702 - DNA, 14 bp, synthetic construct
  source 1..14: mol_type = other DNA
cggtccaaggctgc

SEQ ID NO: 703 - DNA, 14 bp, synthetic construct
  source 1..14: mol_type = other DNA
gccggtgaaagtag

SEQ ID NO: 704 - DNA, 14 bp, synthetic construct
  source 1..14: mol_type = other DNA
ataacgaagccggt

SEQ ID NO: 705 - DNA, 14 bp, synthetic construct
  source 1..14: mol_type = other DNA
caatcgagtcgggg

SEQ ID NO: 706 - DNA, 14 bp, synthetic construct
  source 1..14: mol_type = other DNA
ctccaggccagctg

SEQ ID NO: 707 - DNA, 14 bp, synthetic construct
  source 1..14: mol_type = other DNA
attgggaccaggga

SEQ ID NO: 708 - DNA, 14 bp, synthetic construct
  source 1..14: mol_type = other DNA
cagactgcggatag

SEQ ID NO: 709 - DNA, 14 bp, synthetic construct
  source 1..14: mol_type = other DNA
cgtaacaggaggct

SEQ ID NO: 710 - DNA, 14 bp, synthetic construct
  source 1..14: mol_type = other DNA
agccagttgccgag

SEQ ID NO: 711 - DNA, 14 bp, synthetic construct
  source 1..14: mol_type = other DNA
ggacgacgattgac

SEQ ID NO: 712 - DNA, 14 bp, synthetic construct
  source 1..14: mol_type = other DNA
aatgcatacacaga

SEQ ID NO: 713 - DNA, 14 bp, synthetic construct
  source 1..14: mol_type = other DNA
tcgaacatagggcc

SEQ ID NO: 714 - DNA, 14 bp, synthetic construct
  source 1..14: mol_type = other DNA
cgacgatcggccat

SEQ ID NO: 715 - DNA, 14 bp, synthetic construct
  source 1..14: mol_type = other DNA
caaaaagctacatg

SEQ ID NO: 716 - DNA, 14 bp, synthetic construct
  source 1..14: mol_type = other DNA
aatggtcagccggg

SEQ ID NO: 717 - DNA, 14 bp, synthetic construct
  source 1..14: mol_type = other DNA
ggggtaaccatcaa

SEQ ID NO: 718 - DNA, 14 bp, synthetic construct
  source 1..14: mol_type = other DNA
gatcgggatccccg

SEQ ID NO: 719 - DNA, 14 bp, synthetic construct
  source 1..14: mol_type = other DNA
aagggagtccatga

SEQ ID NO: 720 - DNA, 14 bp, synthetic construct
  source 1..14: mol_type = other DNA
tcggtgcggaccca

SEQ ID NO: 721 - DNA, 14 bp, synthetic construct
  source 1..14: mol_type = other DNA
caggagagccttcc

SEQ ID NO: 722 - DNA, 14 bp, synthetic construct
  source 1..14: mol_type = other DNA
aaagaacggcttgc

SEQ ID NO: 723 - DNA, 14 bp, synthetic construct
  source 1..14: mol_type = other DNA
cataacatcgcgga

SEQ ID NO: 724 - DNA, 14 bp, synthetic construct
  source 1..14: mol_type = other DNA
aaccaggcatgcct

SEQ ID NO: 725 - DNA, 14 bp, synthetic construct
  source 1..14: mol_type = other DNA
cgcaagctgctagc

SEQ ID NO: 726 - DNA, 14 bp, synthetic construct
  source 1..14: mol_type = other DNA
gctagatgcaggcg

SEQ ID NO: 727 - DNA, 14 bp, synthetic construct
  source 1..14: mol_type = other DNA
ggactgggtagccg

SEQ ID NO: 728 - DNA, 14 bp, synthetic construct
  source 1..14: mol_type = other DNA
cggtagcacagtac

SEQ ID NO: 729 - DNA, 14 bp, synthetic construct
  source 1..14: mol_type = other DNA
tagcactgaggaag

SEQ ID NO: 730 - DNA, 14 bp, synthetic construct
  source 1..14: mol_type = other DNA
tgggcatccacgca

SEQ ID NO: 731 - DNA, 14 bp, synthetic construct
  source 1..14: mol_type = other DNA
cctaaaaatcaagc

SEQ ID NO: 732 - DNA, 14 bp, synthetic construct
  source 1..14: mol_type = other DNA
gtcgtacccccaca

SEQ ID NO: 733 - DNA, 14 bp, synthetic construct
  source 1..14: mol_type = other DNA
gtgcgagcacggat

SEQ ID NO: 734 - DNA, 14 bp, synthetic construct
  source 1..14: mol_type = other DNA
caagatggccactg

SEQ ID NO: 735 - DNA, 14 bp, synthetic construct
  source 1..14: mol_type = other DNA
cgtcgagcctccac

SEQ ID NO: 736 - DNA, 14 bp, synthetic construct
  source 1..14: mol_type = other DNA
gagggttcgagaag

SEQ ID NO: 737 - DNA, 14 bp, synthetic construct
  source 1..14: mol_type = other DNA
cgacgtgagaccta

SEQ ID NO: 738 - DNA, 14 bp, synthetic construct
  source 1..14: mol_type = other DNA
gaggccgatgatcc

SEQ ID NO: 739 - DNA, 14 bp, synthetic construct
  source 1..14: mol_type = other DNA
cacctccgtcccca

SEQ ID NO: 740 - DNA, 14 bp, synthetic construct
  source 1..14: mol_type = other DNA
gaatggagctcggg

SEQ ID NO: 741 - DNA, 14 bp, synthetic construct
  source 1..14: mol_type = other DNA
actgagtggccccg

SEQ ID NO: 742 - DNA, 14 bp, synthetic construct
  source 1..14: mol_type = other DNA
agactagccacatc

SEQ ID NO: 743 - DNA, 14 bp, synthetic construct
  source 1..14: mol_type = other DNA
cacgatgatccaca

SEQ ID NO: 744 - DNA, 14 bp, synthetic construct
  source 1..14: mol_type = other DNA
acaaccgtacaata

SEQ ID NO: 745 - DNA, 14 bp, synthetic construct
  source 1..14: mol_type = other DNA
gagagcggtcgctc

SEQ ID NO: 746 - DNA, 14 bp, synthetic construct
  source 1..14: mol_type = other DNA
ccaggccaagcttc

SEQ ID NO: 747 - DNA, 14 bp, synthetic construct
  source 1..14: mol_type = other DNA
gtgacgtgcccgcg

SEQ ID NO: 748 - DNA, 14 bp, synthetic construct
  source 1..14: mol_type = other DNA
tggaacagccgtgg

SEQ ID NO: 749 - DNA, 14 bp, synthetic construct
  source 1..14: mol_type = other DNA
cccaacttaacgga

SEQ ID NO: 750 - DNA, 14 bp, synthetic construct
  source 1..14: mol_type = other DNA
catcgaaaggcctc

SEQ ID NO: 751 - DNA, 14 bp, synthetic construct
  source 1..14: mol_type = other DNA
gaagctaaaacagt

SEQ ID NO: 752 - DNA, 14 bp, synthetic construct
  source 1..14: mol_type = other DNA
atgctcccacccga

SEQ ID NO: 753 - DNA, 14 bp, synthetic construct
  source 1..14: mol_type = other DNA
agcacagtgtggac

SEQ ID NO: 754 - DNA, 14 bp, synthetic construct
  source 1..14: mol_type = other DNA
ggctgagacggtga

SEQ ID NO: 755 - DNA, 14 bp, synthetic construct
  source 1..14: mol_type = other DNA
taatgcgcggccgc

SEQ ID NO: 756 - DNA, 14 bp, synthetic construct
  source 1..14: mol_type = other DNA
tgccacgcacatcg

SEQ ID NO: 757 - DNA, 14 bp, synthetic construct
  source 1..14: mol_type = other DNA
gcctgtaccaggaa

SEQ ID NO: 758 - DNA, 14 bp, synthetic construct
  source 1..14: mol_type = other DNA
gcgggtacacgtcc

SEQ ID NO: 759 - DNA, 14 bp, synthetic construct
  source 1..14: mol_type = other DNA
gggaccgagcagtt

SEQ ID NO: 760 - DNA, 14 bp, synthetic construct
  source 1..14: mol_type = other DNA
tggggcaaggtgac

SEQ ID NO: 761 - DNA, 14 bp, synthetic construct
  source 1..14: mol_type = other DNA
caaggcatctcgca

SEQ ID NO: 762 - DNA, 14 bp, synthetic construct
  source 1..14: mol_type = other DNA
aaagtgagccgtca

SEQ ID NO: 763 - DNA, 14 bp, synthetic construct
  source 1..14: mol_type = other DNA
gaattcggcaccaa

SEQ ID NO: 764 - DNA, 14 bp, synthetic construct
  source 1..14: mol_type = other DNA
cgaagtaaggtaaa

SEQ ID NO: 765 - DNA, 14 bp, synthetic construct
  source 1..14: mol_type = other DNA
aagaccgtgacgat

SEQ ID NO: 766 - DNA, 14 bp, synthetic construct
  source 1..14: mol_type = other DNA
tacacgacctcaca

SEQ ID NO: 767 - DNA, 14 bp, synthetic construct
  source 1..14: mol_type = other DNA
ttgcaagggggcga

SEQ ID NO: 768 - DNA, 14 bp, synthetic construct
  source 1..14: mol_type = other DNA
gactaaacagccct

SEQ ID NO: 769 - DNA, 14 bp, synthetic construct
  source 1..14: mol_type = other DNA
caacaacactagtg

SEQ ID NO: 770 - DNA, 14 bp, synthetic construct
  source 1..14: mol_type = other DNA
aagggaaatactga

SEQ ID NO: 771 - DNA, 14 bp, synthetic construct
  source 1..14: mol_type = other DNA
agactggtaaagcg

SEQ ID NO: 772 - DNA, 14 bp, synthetic construct
  source 1..14: mol_type = other DNA
aatcgaaagtaccg

SEQ ID NO: 773 - DNA, 14 bp, synthetic construct
  source 1..14: mol_type = other DNA
gccgtaccaaataa

SEQ ID NO: 774 - DNA, 14 bp, synthetic construct
  source 1..14: mol_type = other DNA
ataaagctgagcga

SEQ ID NO: 775 - DNA, 14 bp, synthetic construct
  source 1..14: mol_type = other DNA
aactccggaggtac

SEQ ID NO: 776 - DNA, 14 bp, synthetic construct
  source 1..14: mol_type = other DNA
tccctagccgaaaa

SEQ ID NO: 777 - DNA, 14 bp, synthetic construct
  source 1..14: mol_type = other DNA
cggctgcacagctg

SEQ ID NO: 778 - DNA, 14 bp, synthetic construct
  source 1..14: mol_type = other DNA
ctgccaaactacca

SEQ ID NO: 779 - DNA, 14 bp, synthetic construct
  source 1..14: mol_type = other DNA
aaattgcgcgaacg

SEQ ID NO: 780 - DNA, 14 bp, synthetic construct
  source 1..14: mol_type = other DNA
aggtagcgagtcgg

SEQ ID NO: 781 - DNA, 14 bp, synthetic construct
  source 1..14: mol_type = other DNA
cgaaacgcgcttac

SEQ ID NO: 782 - DNA, 14 bp, synthetic construct
  source 1..14: mol_type = other DNA
gcatacaactccca

SEQ ID NO: 783 - DNA, 14 bp, synthetic construct
  source 1..14: mol_type = other DNA
cggacgatcgtcac

SEQ ID NO: 784 - DNA, 14 bp, synthetic construct
  source 1..14: mol_type = other DNA
ctggcagctgcgaa

SEQ ID NO: 785 - DNA, 14 bp, synthetic construct
  source 1..14: mol_type = other DNA
gcgaaatcctacca

SEQ ID NO: 786 - DNA, 14 bp, synthetic construct
  source 1..14: mol_type = other DNA
atccccagaagtga

SEQ ID NO: 787 - DNA, 14 bp, synthetic construct
  source 1..14: mol_type = other DNA
taacaactgagcac

SEQ ID NO: 788 - DNA, 14 bp, synthetic construct
  source 1..14: mol_type = other DNA
cgacccaagctggt

SEQ ID NO: 789 - DNA, 14 bp, synthetic construct
  source 1..14: mol_type = other DNA
gcagggggataatg

SEQ ID NO: 790 - DNA, 14 bp, synthetic construct
  source 1..14: mol_type = other DNA
gggagtcggcctaa

SEQ ID NO: 791 - DNA, 14 bp, synthetic construct
  source 1..14: mol_type = other DNA
tatcaagcagaaca

SEQ ID NO: 792 - DNA, 14 bp, synthetic construct
  source 1..14: mol_type = other DNA
ccggcaaatacgtg

SEQ ID NO: 793 - DNA, 14 bp, synthetic construct
  source 1..14: mol_type = other DNA
ataatagggaagga

SEQ ID NO: 794 - DNA, 14 bp, synthetic construct
  source 1..14: mol_type = other DNA
gtgagatggaacgg

SEQ ID NO: 795 - DNA, 14 bp, synthetic construct
  source 1..14: mol_type = other DNA
cccagtgagcgggt

SEQ ID NO: 796 - DNA, 14 bp, synthetic construct
  source 1..14: mol_type = other DNA
aaatgctggggccg

SEQ ID NO: 797 - DNA, 14 bp, synthetic construct
  source 1..14: mol_type = other DNA
atgtggcggccgcg

SEQ ID NO: 798 - DNA, 14 bp, synthetic construct
  source 1..14: mol_type = other DNA
tcctccagcccgcc

SEQ ID NO: 799 - DNA, 14 bp, synthetic construct
  source 1..14: mol_type = other DNA
acagcataatgcca

SEQ ID NO: 800 - DNA, 14 bp, synthetic construct
  source 1..14: mol_type = other DNA
tggcgagacctcgg

SEQ ID NO: 801 - DNA, 14 bp, synthetic construct
  source 1..14: mol_type = other DNA
gatagacagtgggg

SEQ ID NO: 802 - DNA, 14 bp, synthetic construct
  source 1..14: mol_type = other DNA
ggacccgttgacgg

SEQ ID NO: 803 - DNA, 14 bp, synthetic construct
  source 1..14: mol_type = other DNA
ggatggaaatgaca

SEQ ID NO: 804 - DNA, 14 bp, synthetic construct
  source 1..14: mol_type = other DNA
cctaccacacggtc

SEQ ID NO: 805 - DNA, 14 bp, synthetic construct
  source 1..14: mol_type = other DNA
aacggaagagagtt

SEQ ID NO: 806 - DNA, 14 bp, synthetic construct
  source 1..14: mol_type = other DNA
gagtacgtgaccac

SEQ ID NO: 807 - DNA, 14 bp, synthetic construct
  source 1..14: mol_type = other DNA
gagactgcgactcc

SEQ ID NO: 808 - DNA, 14 bp, synthetic construct
  source 1..14: mol_type = other DNA
ccctgcgcacgtcg

SEQ ID NO: 809 - DNA, 14 bp, synthetic construct
  source 1..14: mol_type = other DNA
ggtggagaaagaat

SEQ ID NO: 810 - DNA, 14 bp, synthetic construct
  source 1..14: mol_type = other DNA
gtaacgtcagcgcc

SEQ ID NO: 811 - DNA, 14 bp, synthetic construct
  source 1..14: mol_type = other DNA
gggcaggcatataa

SEQ ID NO: 812 - DNA, 14 bp, synthetic construct
  source 1..14: mol_type = other DNA
gcagcggatctgag

SEQ ID NO: 813 - DNA, 14 bp, synthetic construct
  source 1..14: mol_type = other DNA
ctgactcgggcgga

SEQ ID NO: 814 - DNA, 14 bp, synthetic construct
  source 1..14: mol_type = other DNA
ctgacctgcaaagc

SEQ ID NO: 815 - DNA, 14 bp, synthetic construct
  source 1..14: mol_type = other DNA
gggcaattggacca

SEQ ID NO: 816 - DNA, 14 bp, synthetic construct
  source 1..14: mol_type = other DNA
cccggaatatgcgg

SEQ ID NO: 817 - DNA, 14 bp, synthetic construct
  source 1..14: mol_type = other DNA
caatgggtaacaaa

SEQ ID NO: 818 - DNA, 14 bp, synthetic construct
  source 1..14: mol_type = other DNA
gaaattgcccgaca

SEQ ID NO: 819 - DNA, 14 bp, synthetic construct
  source 1..14: mol_type = other DNA
gggatccatgcaga

SEQ ID NO: 820 - DNA, 14 bp, synthetic construct
  source 1..14: mol_type = other DNA
tgccggagaccaat

SEQ ID NO: 821 - DNA, 14 bp, synthetic construct
  source 1..14: mol_type = other DNA
tctgaagaaagaga

SEQ ID NO: 822 - DNA, 14 bp, synthetic construct
  source 1..14: mol_type = other DNA
gacccgtagggtcg

SEQ ID NO: 823 - DNA, 14 bp, synthetic construct
  source 1..14: mol_type = other DNA
ccacttggcagacg

SEQ ID NO: 824 - DNA, 14 bp, synthetic construct
  source 1..14: mol_type = other DNA
atctgacgcggcca

SEQ ID NO: 825 - DNA, 14 bp, synthetic construct
  source 1..14: mol_type = other DNA
aaggatacggccgt

SEQ ID NO: 826 - DNA, 14 bp, synthetic construct
  source 1..14: mol_type = other DNA
acgaaggcctgagt

SEQ ID NO: 827 - DNA, 14 bp, synthetic construct
  source 1..14: mol_type = other DNA
ccactcccgatacc

SEQ ID NO: 828 - DNA, 14 bp, synthetic construct
  source 1..14: mol_type = other DNA
acgtcccgtaacgg

SEQ ID NO: 829 - DNA, 14 bp, synthetic construct
  source 1..14: mol_type = other DNA
aaatctgagcggag

SEQ ID NO: 830 - DNA, 14 bp, synthetic construct
  source 1..14: mol_type = other DNA
ccgcgttccccaga

SEQ ID NO: 831 - DNA, 14 bp, synthetic construct
  source 1..14: mol_type = other DNA
agagtgctcccgaa

SEQ ID NO: 832 - DNA, 14 bp, synthetic construct
  source 1..14: mol_type = other DNA
cgcagcgtcagtcg

SEQ ID NO: 833 - DNA, 14 bp, synthetic construct
  source 1..14: mol_type = other DNA
cgcgactctcggcc

SEQ ID NO: 834 - DNA, 14 bp, synthetic construct
  source 1..14: mol_type = other DNA
actgtcgaccgggc

SEQ ID NO: 835 - DNA, 14 bp, synthetic construct
  source 1..14: mol_type = other DNA
gggggtaagacaat

SEQ ID NO: 836 - DNA, 14 bp, synthetic construct
  source 1..14: mol_type = other DNA
caaaacctatgcac

SEQ ID NO: 837 - DNA, 14 bp, synthetic construct
  source 1..14: mol_type = other DNA
aaaaagttgcgccg

SEQ ID NO: 838 - DNA, 14 bp, synthetic construct
  source 1..14: mol_type = other DNA
aaccggctaggtac

SEQ ID NO: 839 - DNA, 14 bp, synthetic construct
  source 1..14: mol_type = other DNA
ggccgtacaagatg

SEQ ID NO: 840 - DNA, 14 bp, synthetic construct
  source 1..14: mol_type = other DNA
cgcacctcagtcgc

SEQ ID NO: 841 - DNA, 14 bp, synthetic construct
  source 1..14: mol_type = other DNA
agttcagagcgggc

SEQ ID NO: 842 - DNA, 14 bp, synthetic construct
  source 1..14: mol_type = other DNA
gcaactgactgcca

SEQ ID NO: 843 - DNA, 14 bp, synthetic construct
  source 1..14: mol_type = other DNA
taggcgacactaag

SEQ ID NO: 844 - DNA, 14 bp, synthetic construct
  source 1..14: mol_type = other DNA
cctactcgccgaag

SEQ ID NO: 845 - DNA, 14 bp, synthetic construct
  source 1..14: mol_type = other DNA
agcgcagatataca

SEQ ID NO: 846 - DNA, 14 bp, synthetic construct
  source 1..14: mol_type = other DNA
ggggtaacgctacc

SEQ ID NO: 847 - DNA, 14 bp, synthetic construct
  source 1..14: mol_type = other DNA
cagtcatacagaca

SEQ ID NO: 848 - DNA, 14 bp, synthetic construct
  source 1..14: mol_type = other DNA
gcttcgccacgcca

SEQ ID NO: 849 - DNA, 14 bp, synthetic construct
  source 1..14: mol_type = other DNA
acagcgcgtcggtg

SEQ ID NO: 850 - DNA, 14 bp, synthetic construct
  source 1..14: mol_type = other DNA
gagacaaatccgta

SEQ ID NO: 851 - DNA, 14 bp, synthetic construct
  source 1..14: mol_type = other DNA
gccagaacggttgg

SEQ ID NO: 852 - DNA, 14 bp, synthetic construct
  source 1..14: mol_type = other DNA
ccccacctcgctac

SEQ ID NO: 853 - DNA, 14 bp, synthetic construct
  source 1..14: mol_type = other DNA
tcaagactacggcg

SEQ ID NO: 854 - DNA, 14 bp, synthetic construct
  source 1..14: mol_type = other DNA
gcggagtaccctgc

SEQ ID NO: 855 - DNA, 14 bp, synthetic construct
  source 1..14: mol_type = other DNA
cccatgtcgcaagc

SEQ ID NO: 856 - DNA, 14 bp, synthetic construct
  source 1..14: mol_type = other DNA
agcctcggaaatca

SEQ ID NO: 857 - DNA, 14 bp, synthetic construct
  source 1..14: mol_type = other DNA
ggcgagatcgataa

SEQ ID NO: 858 - DNA, 14 bp, synthetic construct
  source 1..14: mol_type = other DNA
gcttataaacacca

SEQ ID NO: 859 - DNA, 14 bp, synthetic construct
  source 1..14: mol_type = other DNA
tggcaggtccccgt

SEQ ID NO: 860 - DNA, 14 bp, synthetic construct
  source 1..14: mol_type = other DNA
cgtgtagcaataaa

SEQ ID NO: 861 - DNA, 14 bp, synthetic construct
  source 1..14: mol_type = other DNA
atgagactaagtag

SEQ ID NO: 862 - DNA, 14 bp, synthetic construct
  source 1..14: mol_type = other DNA
gttgaacctgggaa

SEQ ID NO: 863 - DNA, 14 bp, synthetic construct
  source 1..14: mol_type = other DNA
acgcggatcattca

SEQ ID NO: 864 - DNA, 14 bp, synthetic construct
  source 1..14: mol_type = other DNA
taggtcagtgagaa

SEQ ID NO: 865 - DNA, 14 bp, synthetic construct
  source 1..14: mol_type = other DNA
tttccccgggcggc

SEQ ID NO: 866 - DNA, 14 bp, synthetic construct
  source 1..14: mol_type = other DNA
gaccgtttgcgcag

SEQ ID NO: 867 - DNA, 14 bp, synthetic construct
  source 1..14: mol_type = other DNA
tcggggacatcagt

SEQ ID NO: 868 - DNA, 14 bp, synthetic construct
  source 1..14: mol_type = other DNA
cataccttaggacc

SEQ ID NO: 869 - DNA, 14 bp, synthetic construct
  source 1..14: mol_type = other DNA
gcactctgcagtac

SEQ ID NO: 870 - DNA, 14 bp, synthetic construct
  source 1..14: mol_type = other DNA
gcctagcgtcgctc

SEQ ID NO: 871 - DNA, 14 bp, synthetic construct
  source 1..14: mol_type = other DNA
ctaacggtgtagca

SEQ ID NO: 872 - DNA, 14 bp, synthetic construct
  source 1..14: mol_type = other DNA
cgcaaacgtttcaa

SEQ ID NO: 873 - DNA, 14 bp, synthetic construct
  source 1..14: mol_type = other DNA
gcaggcgtgatgat

SEQ ID NO: 874 - DNA, 14 bp, synthetic construct
  source 1..14: mol_type = other DNA
taacaaacaatggt

SEQ ID NO: 875 - DNA, 14 bp, synthetic construct
  source 1..14: mol_type = other DNA
ttccacaaggtcgg

SEQ ID NO: 876 - DNA, 14 bp, synthetic construct
  source 1..14: mol_type = other DNA
gagctccctacact

SEQ ID NO: 877 - DNA, 14 bp, synthetic construct
  source 1..14: mol_type = other DNA
gtgctacgaacgtc

SEQ ID NO: 878 - DNA, 14 bp, synthetic construct
  source 1..14: mol_type = other DNA
gttcccgctaccac

SEQ ID NO: 879 - DNA, 14 bp, synthetic construct
  source 1..14: mol_type = other DNA
ccccaatagtctcc

SEQ ID NO: 880 - DNA, 14 bp, synthetic construct
  source 1..14: mol_type = other DNA
agtaggaagatcgt

SEQ ID NO: 881 - DNA, 14 bp, synthetic construct
  source 1..14: mol_type = other DNA
gacgccttgcgcta

SEQ ID NO: 882 - DNA, 14 bp, synthetic construct
  source 1..14: mol_type = other DNA
tcgatccacgcaat

SEQ ID NO: 883 - DNA, 14 bp, synthetic construct
  source 1..14: mol_type = other DNA
tgctgcgaagtccg

SEQ ID NO: 884 - DNA, 14 bp, synthetic construct
  source 1..14: mol_type = other DNA
tatccatgaccaga

SEQ ID NO: 885 - DNA, 14 bp, synthetic construct
  source 1..14: mol_type = other DNA
ggaagattatccca

SEQ ID NO: 886 - DNA, 14 bp, synthetic construct
  source 1..14: mol_type = other DNA
taacgggcattaca

SEQ ID NO: 887 - DNA, 14 bp, synthetic construct
  source 1..14: mol_type = other DNA
ctggggagcctcta

SEQ ID NO: 888 - DNA, 14 bp, synthetic construct
  source 1..14: mol_type = other DNA
actaaatagggctc

SEQ ID NO: 889 - DNA, 14 bp, synthetic construct
  source 1..14: mol_type = other DNA
ttcccgcaatcgac

SEQ ID NO: 890 - DNA, 14 bp, synthetic construct
  source 1..14: mol_type = other DNA
tgaccccctagcgt

SEQ ID NO: 891 - DNA, 14 bp, synthetic construct
  source 1..14: mol_type = other DNA
atgtccaggcgcta

SEQ ID NO: 892 - DNA, 14 bp, synthetic construct
  source 1..14: mol_type = other DNA
ccagatcccccttg

SEQ ID NO: 893 - DNA, 14 bp, synthetic construct
  source 1..14: mol_type = other DNA
cgtggacggttaga

SEQ ID NO: 894 - DNA, 14 bp, synthetic construct
  source 1..14: mol_type = other DNA
tccctggctcgcaa

SEQ ID NO: 895 - DNA, 14 bp, synthetic construct
  source 1..14: mol_type = other DNA
atacaccgtatgac

SEQ ID NO: 896 - DNA, 14 bp, synthetic construct
  source 1..14: mol_type = other DNA
acgattaccacctc

SEQ ID NO: 897 - DNA, 14 bp, synthetic construct
  source 1..14: mol_type = other DNA
agtaatagcataca

SEQ ID NO: 898 - DNA, 14 bp, synthetic construct
  source 1..14: mol_type = other DNA
gaaggtctgactac

SEQ ID NO: 899 - DNA, 14 bp, synthetic construct
  source 1..14: mol_type = other DNA
tggccaggtgctaa

SEQ ID NO: 900 - DNA, 14 bp, synthetic construct
  source 1..14: mol_type = other DNA
atgtggcgaatcca

SEQ ID NO: 901 - DNA, 14 bp, synthetic construct
  source 1..14: mol_type = other DNA
ggccttcagagtca

SEQ ID NO: 902 - DNA, 14 bp, synthetic construct
  source 1..14: mol_type = other DNA
cccacgcgtcaatt

SEQ ID NO: 903 - DNA, 14 bp, synthetic construct
  source 1..14: mol_type = other DNA
ccatagacgcggtt

SEQ ID NO: 904 - DNA, 14 bp, synthetic construct
  source 1..14: mol_type = other DNA
ttcacaaacacaat

SEQ ID NO: 905 - DNA, 14 bp, synthetic construct
  source 1..14: mol_type = other DNA
agctattcacccaa

SEQ ID NO: 906 - DNA, 14 bp, synthetic construct
  source 1..14: mol_type = other DNA
tcggggtaaacata

SEQ ID NO: 907 - DNA, 14 bp, synthetic construct
  source 1..14: mol_type = other DNA
ctggggctgctacg

SEQ ID NO: 908 - DNA, 14 bp, synthetic construct
  source 1..14: mol_type = other DNA
cgctgatgtggcaa

SEQ ID NO: 909 - DNA, 14 bp, synthetic construct
  source 1..14: mol_type = other DNA
cgtccctgtcgccc

SEQ ID NO: 910 - DNA, 14 bp, synthetic construct
  source 1..14: mol_type = other DNA
ttgagagtgacccg

SEQ ID NO: 911 - DNA, 14 bp, synthetic construct
  source 1..14: mol_type = other DNA
caagaattacaagt

SEQ ID NO: 912 - DNA, 14 bp, synthetic construct
  source 1..14: mol_type = other DNA
atgacgggtcgtcc

SEQ ID NO: 913 - DNA, 14 bp, synthetic construct
  source 1..14: mol_type = other DNA
tcttgcaaacccaa

SEQ ID NO: 914 - DNA, 14 bp, synthetic construct
  source 1..14: mol_type = other DNA
attggagtgggcag

SEQ ID NO: 915 - DNA, 14 bp, synthetic construct
  source 1..14: mol_type = other DNA
acgaggtcgctggt

SEQ ID NO: 916 - DNA, 14 bp, synthetic construct
  source 1..14: mol_type = other DNA
ggcagtacacctat

SEQ ID NO: 917 - DNA, 14 bp, synthetic construct
  source 1..14: mol_type = other DNA
tctcggacgtaacc

SEQ ID NO: 918 - DNA, 14 bp, synthetic construct
  source 1..14: mol_type = other DNA
gctgctgtccccgg

SEQ ID NO: 919 - DNA, 14 bp, synthetic construct
  source 1..14: mol_type = other DNA
aggtggatacgcgt

SEQ ID NO: 920 - DNA, 14 bp, synthetic construct
  source 1..14: mol_type = other DNA
cgtcgtagagatac

SEQ ID NO: 921 - DNA, 14 bp, synthetic construct
  source 1..14: mol_type = other DNA
gtaacacgcctcat

SEQ ID NO: 922 - DNA, 14 bp, synthetic construct
  source 1..14: mol_type = other DNA
cgaactacgaactt

SEQ ID NO: 923 - DNA, 14 bp, synthetic construct
  source 1..14: mol_type = other DNA
taagcaagttcacg

SEQ ID NO: 924 - DNA, 14 bp, synthetic construct
  source 1..14: mol_type = other DNA
acaggtgcgcgtta

SEQ ID NO: 925 - DNA, 14 bp, synthetic construct
  source 1..14: mol_type = other DNA
cacctgcctaaata

SEQ ID NO: 926 - DNA, 14 bp, synthetic construct
  source 1..14: mol_type = other DNA
cgccagcagtggtt

SEQ ID NO: 927 - DNA, 14 bp, synthetic construct
  source 1..14: mol_type = other DNA
gtgagatactcggc

SEQ ID NO: 928 - DNA, 14 bp, synthetic construct
  source 1..14: mol_type = other DNA
tgccagctaaactc

SEQ ID NO: 929 - DNA, 14 bp, synthetic construct
  source 1..14: mol_type = other DNA
ctgaactcagctgc

SEQ ID NO: 930 - DNA, 14 bp, synthetic construct
  source 1..14: mol_type = other DNA
attgtccacggaag

SEQ ID NO: 931 - DNA, 14 bp, synthetic construct
  source 1..14: mol_type = other DNA
atcgtcgtaggcgg

SEQ ID NO: 932 - DNA, 14 bp, synthetic construct
  source 1..14: mol_type = other DNA
cctgggcatccgta

SEQ ID NO: 933 - DNA, 14 bp, synthetic construct
  source 1..14: mol_type = other DNA
cgtccaagaccatt

SEQ ID NO: 934 - DNA, 14 bp, synthetic construct
  source 1..14: mol_type = other DNA
cgggtcttccgcca

SEQ ID NO: 935 - DNA, 14 bp, synthetic construct
  source 1..14: mol_type = other DNA
gatggtgagaacta

SEQ ID NO: 936 - DNA, 14 bp, synthetic construct
  source 1..14: mol_type = other DNA
ccataactaggcta

SEQ ID NO: 937 - DNA, 14 bp, synthetic construct
  source 1..14: mol_type = other DNA
tagaaggcttcgaa

SEQ ID NO: 938 - DNA, 14 bp, synthetic construct
  source 1..14: mol_type = other DNA
cacgaatgtgcact

SEQ ID NO: 939 - DNA, 14 bp, synthetic construct
  source 1..14: mol_type = other DNA
gtaaactgatacag

SEQ ID NO: 940 - DNA, 14 bp, synthetic construct
  source 1..14: mol_type = other DNA
tgtcacataaggca

SEQ ID NO: 941 - DNA, 14 bp, synthetic construct
  source 1..14: mol_type = other DNA
cccgtaaccttggc

SEQ ID NO: 942 - DNA, 14 bp, synthetic construct
  source 1..14: mol_type = other DNA
aaaagtggcattcc

SEQ ID NO: 943 - DNA, 14 bp, synthetic construct
  source 1..14: mol_type = other DNA
gactggatcatcaa

SEQ ID NO: 944 - DNA, 14 bp, synthetic construct
  source 1..14: mol_type = other DNA
taccgatgtccccc

SEQ ID NO: 945 - DNA, 14 bp, synthetic construct
  source 1..14: mol_type = other DNA
gagagtataaactg

SEQ ID NO: 946 - DNA, 14 bp, synthetic construct
  source 1..14: mol_type = other DNA
acaagtgcgtctag

SEQ ID NO: 947 - DNA, 14 bp, synthetic construct
  source 1..14: mol_type = other DNA
gtcctgagagtcaa

SEQ ID NO: 948 - DNA, 14 bp, synthetic construct
  source 1..14: mol_type = other DNA
gaatcgctgtgacg

SEQ ID NO: 949 - DNA, 14 bp, synthetic construct
  source 1..14: mol_type = other DNA
attagggaagtaaa

SEQ ID NO: 950 - DNA, 14 bp, synthetic construct
  source 1..14: mol_type = other DNA
gcctagtcaatcaa

SEQ ID NO: 951 - DNA, 14 bp, synthetic construct
  source 1..14: mol_type = other DNA
atgcgtacagtgca

SEQ ID NO: 952 - DNA, 14 bp, synthetic construct
  source 1..14: mol_type = other DNA
aataagtgatgaac

SEQ ID NO: 953 - DNA, 14 bp, synthetic construct
  source 1..14: mol_type = other DNA
taacactactaaga

SEQ ID NO: 954 - DNA, 14 bp, synthetic construct
  source 1..14: mol_type = other DNA
gaggactgtagatg

SEQ ID NO: 955 - DNA, 14 bp, synthetic construct
  source 1..14: mol_type = other DNA
atactaaatgcagg

SEQ ID NO: 956 - DNA, 14 bp, synthetic construct
  source 1..14: mol_type = other DNA
cgacttaaaaactc

SEQ ID NO: 957 - DNA, 14 bp, synthetic construct
  source 1..14: mol_type = other DNA
ttaacccaggtaac

SEQ ID NO: 958 - DNA, 14 bp, synthetic construct
  source 1..14: mol_type = other DNA
ccgctaataatagc

SEQ ID NO: 959 - DNA, 14 bp, synthetic construct
  source 1..14: mol_type = other DNA
ccggcaatgggtgt

SEQ ID NO: 960 - DNA, 14 bp, synthetic construct
  source 1..14: mol_type = other DNA
cgttaaagtaaacg

SEQ ID NO: 961 - DNA, 14 bp, synthetic construct
  source 1..14: mol_type = other DNA
gcctaagctacgat

SEQ ID NO: 962 - DNA, 14 bp, synthetic construct
  source 1..14: mol_type = other DNA
acagcggctatatc

SEQ ID NO: 963 - DNA, 14 bp, synthetic construct
  source 1..14: mol_type = other DNA
tgataacagtcgac

SEQ ID NO: 964 - DNA, 14 bp, synthetic construct
  source 1..14: mol_type = other DNA
agggctctctccag

SEQ ID NO: 965 - DNA, 14 bp, synthetic construct
  source 1..14: mol_type = other DNA
cagggaggagtctt

SEQ ID NO: 966 - DNA, 14 bp, synthetic construct
  source 1..14: mol_type = other DNA
gcgatgtccgactg

SEQ ID NO: 967 - DNA, 14 bp, synthetic construct
  source 1..14: mol_type = other DNA
gagcctcctctaaa

SEQ ID NO: 968 - DNA, 14 bp, synthetic construct
  source 1..14: mol_type = other DNA
atgagtaagctaac

SEQ ID NO: 969 - DNA, 14 bp, synthetic construct
  source 1..14: mol_type = other DNA
cacaaggcaatctt

SEQ ID NO: 970 - DNA, 14 bp, synthetic construct
  source 1..14: mol_type = other DNA
tcaatcccccacta

SEQ ID NO: 971 - DNA, 14 bp, synthetic construct
  source 1..14: mol_type = other DNA
cgaattctcggacg

SEQ ID NO: 972 - DNA, 14 bp, synthetic construct
  source 1..14: mol_type = other DNA
ggactccttgggcg

SEQ ID NO: 973 - DNA, 14 bp, synthetic construct
  source 1..14: mol_type = other DNA
caaattaggcctag

SEQ ID NO: 974 - DNA, 14 bp, synthetic construct
  source 1..14: mol_type = other DNA
ccatcagtctgcga

SEQ ID NO: 975 - DNA, 14 bp, synthetic construct
  source 1..14: mol_type = other DNA
ccatttgggaaagc

SEQ ID NO: 976 - DNA, 14 bp, synthetic construct
  source 1..14: mol_type = other DNA
ggagtaaagctgta

SEQ ID NO: 977 - DNA, 14 bp, synthetic construct
  source 1..14: mol_type = other DNA
cctcccgaaattgc

SEQ ID NO: 978 - DNA, 14 bp, synthetic construct
  source 1..14: mol_type = other DNA
tgagaggacctgta

SEQ ID NO: 979 - DNA, 14 bp, synthetic construct
  source 1..14: mol_type = other DNA
atacgctgccgctc

SEQ ID NO: 980 - DNA, 14 bp, synthetic construct
  source 1..14: mol_type = other DNA
tcacccgattcaca

SEQ ID NO: 981 - DNA, 14 bp, synthetic construct
  source 1..14: mol_type = other DNA
agctagcctgggta

SEQ ID NO: 982 - DNA, 14 bp, synthetic construct
  source 1..14: mol_type = other DNA
aatagcgatccatg

SEQ ID NO: 983 - DNA, 14 bp, synthetic construct
  source 1..14: mol_type = other DNA
atcccgcatgaatg

SEQ ID NO: 984 - DNA, 14 bp, synthetic construct
  source 1..14: mol_type = other DNA
gtcaatgctcggac

SEQ ID NO: 985 - DNA, 14 bp, synthetic construct
  source 1..14: mol_type = other DNA
cgatacgtgtccaa

SEQ ID NO: 986 - DNA, 14 bp, synthetic construct
  source 1..14: mol_type = other DNA
cagtatgtgggggc

SEQ ID NO: 987 - DNA, 14 bp, synthetic construct
  source 1..14: mol_type = other DNA
acattggcgaagtc

SEQ ID NO: 988 - DNA, 14 bp, synthetic construct
  source 1..14: mol_type = other DNA
taaagatcctacga

SEQ ID NO: 989 - DNA, 14 bp, synthetic construct
  source 1..14: mol_type = other DNA
ctattaagaccgaa

SEQ ID NO: 990 - DNA, 14 bp, synthetic construct
  source 1..14: mol_type = other DNA
acgtccatcgatgg

SEQ ID NO: 991 - DNA, 14 bp, synthetic construct
  source 1..14: mol_type = other DNA
tcaataatcgaagg

SEQ ID NO: 992 - DNA, 14 bp, synthetic construct
  source 1..14: mol_type = other DNA
gtccatatcgcccg

SEQ ID NO: 993 - DNA, 14 bp, synthetic construct
  source 1..14: mol_type = other DNA
gacttcacatgggc

SEQ ID NO: 994 - DNA, 14 bp, synthetic construct
  source 1..14: mol_type = other DNA
cacgggtgttcgaa

SEQ ID NO: 995 - DNA, 14 bp, synthetic construct
  source 1..14: mol_type = other DNA
aagttctcggcaac

SEQ ID NO: 996 - DNA, 14 bp, synthetic construct
  source 1..14: mol_type = other DNA
gcggtagtataccc

SEQ ID NO: 997 - DNA, 14 bp, synthetic construct
  source 1..14: mol_type = other DNA
gtaagtgacaaata

SEQ ID NO: 998 - DNA, 14 bp, synthetic construct
  source 1..14: mol_type = other DNA
cattagaggtccgg

SEQ ID NO: 999 - DNA, 14 bp, synthetic construct
  source 1..14: mol_type = other DNA
cactgccattcgca

SEQ ID NO: 1000 - DNA, 14 bp, synthetic construct
  source 1..14: mol_type = other DNA
gcaccgtcctaatc

SEQ ID NO: 1001 - DNA, 14 bp, synthetic construct
  source 1..14: mol_type = other DNA
cctgtgccacgggt

SEQ ID NO: 1002 - DNA, 14 bp, synthetic construct
  source 1..14: mol_type = other DNA
aagagcgctgctta

SEQ ID NO: 1003 - DNA, 14 bp, synthetic construct
  source 1..14: mol_type = other DNA
gtgggcataccgat

SEQ ID NO: 1004 - DNA, 14 bp, synthetic construct
  source 1..14: mol_type = other DNA
ctttcccaccacgc

SEQ ID NO: 1005 - DNA, 14 bp, synthetic construct
  source 1..14: mol_type = other DNA
attcgtgaaaaaag

SEQ ID NO: 1006 - DNA, 14 bp, synthetic construct
  source 1..14: mol_type = other DNA
aagacttggcctgc

SEQ ID NO: 1007 - DNA, 14 bp, synthetic construct
  source 1..14: mol_type = other DNA
atgtgcacgcaact

SEQ ID NO: 1008 - DNA, 14 bp, synthetic construct
  source 1..14: mol_type = other DNA
aataatgctcacca

SEQ ID NO: 1009 - DNA, 14 bp, synthetic construct
  source 1..14: mol_type = other DNA
gcacagttaggcct

SEQ ID NO: 1010 - DNA, 14 bp, synthetic construct
  source 1..14: mol_type = other DNA
aaaatctacatgcg

SEQ ID NO: 1011 - DNA, 14 bp, synthetic construct
  source 1..14: mol_type = other DNA
aagaaatggtgtcc

SEQ ID NO: 1012 - DNA, 14 bp, synthetic construct
  source 1..14: mol_type = other DNA
acacgccagcgttt

SEQ ID NO: 1013 - DNA, 14 bp, synthetic construct
  source 1..14: mol_type = other DNA
ctgaaattcgcgca

SEQ ID NO: 1014 - DNA, 14 bp, synthetic construct
  source 1..14: mol_type = other DNA
cgatcagatccagt

SEQ ID NO: 1015 - DNA, 14 bp, synthetic construct
  source 1..14: mol_type = other DNA
aggtgaaatcgtcc

SEQ ID NO: 1016 - DNA, 14 bp, synthetic construct
  source 1..14: mol_type = other DNA
tagaaaggagaatt

SEQ ID NO: 1017 - DNA, 14 bp, synthetic construct
  source 1..14: mol_type = other DNA
agcccgttggatac

SEQ ID NO: 1018 - DNA, 14 bp, synthetic construct
  source 1..14: mol_type = other DNA
ccgtctacctgccc

SEQ ID NO: 1019 - DNA, 14 bp, synthetic construct
  source 1..14: mol_type = other DNA
caagagtttccggg

SEQ ID NO: 1020 - DNA, 14 bp, synthetic construct
  source 1..14: mol_type = other DNA
gatcgctgaagtcg

SEQ ID NO: 1021 - DNA, 14 bp, synthetic construct
  source 1..14: mol_type = other DNA
gcggtcaagggtta

SEQ ID NO: 1022 - DNA, 14 bp, synthetic construct
  source 1..14: mol_type = other DNA
acactttggagggg

SEQ ID NO: 1023 - DNA, 14 bp, synthetic construct
  source 1..14: mol_type = other DNA
tagcatagaacgct

SEQ ID NO: 1024 - DNA, 14 bp, synthetic construct
  source 1..14: mol_type = other DNA
gaccgtagtaagct

SEQ ID NO: 1025 - DNA, 14 bp, synthetic construct
  source 1..14: mol_type = other DNA
tacggggttagagg

SEQ ID NO: 1026 - DNA, 14 bp, synthetic construct
  source 1..14: mol_type = other DNA
gcacctaggcggtt

SEQ ID NO: 1027 - DNA, 14 bp, synthetic construct
  source 1..14: mol_type = other DNA
aaaccgtaccgtta

SEQ ID NO: 1028 - DNA, 14 bp, synthetic construct
  source 1..14: mol_type = other DNA
cggggtgtacctac

SEQ ID NO: 1029 - DNA, 14 bp, synthetic construct
  source 1..14: mol_type = other DNA
ggcgcatttccgaa

SEQ ID NO: 1030 - DNA, 14 bp, synthetic construct
  source 1..14: mol_type = other DNA
ggggtgggcaatct

SEQ ID NO: 1031 - DNA, 14 bp, synthetic construct
  source 1..14: mol_type = other DNA
tcgcggtctacgac

SEQ ID NO: 1032 - DNA, 14 bp, synthetic construct
  source 1..14: mol_type = other DNA
tcccaactataacg

SEQ ID NO: 1033 - DNA, 14 bp, synthetic construct
  source 1..14: mol_type = other DNA
tgtcacacgccatc

SEQ ID NO: 1034 - DNA, 14 bp, synthetic construct
  source 1..14: mol_type = other DNA
agtgctcaagaggt

SEQ ID NO: 1035 - DNA, 14 bp, synthetic construct
  source 1..14: mol_type = other DNA
tcccggagtagatg

SEQ ID NO: 1036 - DNA, 14 bp, synthetic construct
  source 1..14: mol_type = other DNA
agctcccgtaggtc

SEQ ID NO: 1037 - DNA, 14 bp, synthetic construct
  source 1..14: mol_type = other DNA
cctgcctcgctagg

SEQ ID NO: 1038 - DNA, 14 bp, synthetic construct
  source 1..14: mol_type = other DNA
tttcccaagcgcca

SEQ ID NO: 1039 - DNA, 14 bp, synthetic construct
  source 1..14: mol_type = other DNA
tccacagtgcgtcg

SEQ ID NO: 1040 - DNA, 14 bp, synthetic construct
  source 1..14: mol_type = other DNA
acggctggttggag

SEQ ID NO: 1041 - DNA, 14 bp, synthetic construct
  source 1..14: mol_type = other DNA
gctccaagatctgg

SEQ ID NO: 1042 - DNA, 14 bp, synthetic construct
  source 1..14: mol_type = other DNA
accgaatgacaatt

SEQ ID NO: 1043 - DNA, 14 bp, synthetic construct
  source 1..14: mol_type = other DNA
tagagcaaacagtt

SEQ ID NO: 1044 - DNA, 14 bp, synthetic construct
  source 1..14: mol_type = other DNA
ggggtcgtcgtgaa

SEQ ID NO: 1045 - DNA, 14 bp, synthetic construct
  source 1..14: mol_type = other DNA
gggggaccagattt

SEQ ID NO: 1046 - DNA, 14 bp, synthetic construct
  source 1..14: mol_type = other DNA
tcagtcacagtgca

SEQ ID NO: 1047 - DNA, 14 bp, synthetic construct
  source 1..14: mol_type = other DNA
ccttccgtagccgg

SEQ ID NO: 1048 - DNA, 14 bp, synthetic construct
  source 1..14: mol_type = other DNA
cgtactcccactca

SEQ ID NO: 1049 - DNA, 14 bp, synthetic construct
  source 1..14: mol_type = other DNA
gtaggctgaacgta

SEQ ID NO: 1050 - DNA, 14 bp, synthetic construct
  source 1..14: mol_type = other DNA
gcctagaccttacg

SEQ ID NO: 1051 - DNA, 14 bp, synthetic construct
  source 1..14: mol_type = other DNA
aacaatcatcctag

SEQ ID NO: 1052 - DNA, 14 bp, synthetic construct
  source 1..14: mol_type = other DNA
tatctacccggcgg

SEQ ID NO: 1053 - DNA, 14 bp, synthetic construct
  source 1..14: mol_type = other DNA
ggggagcctcttac

SEQ ID NO: 1054 - DNA, 14 bp, synthetic construct
  source 1..14: mol_type = other DNA
aaagaaccgacttt

SEQ ID NO: 1055 - DNA, 14 bp, synthetic construct
  source 1..14: mol_type = other DNA
tagagtctggaaga

SEQ ID NO: 1056 - DNA, 14 bp, synthetic construct
  source 1..14: mol_type = other DNA
gttagactagagcc

SEQ ID NO: 1057 - DNA, 14 bp, synthetic construct
  source 1..14: mol_type = other DNA
atcgtccagcgcct

SEQ ID NO: 1058 - DNA, 14 bp, synthetic construct
  source 1..14: mol_type = other DNA
cgggcatcatcatc

SEQ ID NO: 1059 - DNA, 14 bp, synthetic construct
  source 1..14: mol_type = other DNA
atatggaagaatgc

SEQ ID NO: 1060 - DNA, 14 bp, synthetic construct
  source 1..14: mol_type = other DNA
ctgtgagggtggac

SEQ ID NO: 1061 - DNA, 14 bp, synthetic construct
  source 1..14: mol_type = other DNA
tggagttacagggc

SEQ ID NO: 1062 - DNA, 14 bp, synthetic construct
  source 1..14: mol_type = other DNA
ggccaggttccact

SEQ ID NO: 1063 - DNA, 14 bp, synthetic construct
  source 1..14: mol_type = other DNA
aggagatgtccata

SEQ ID NO: 1064 - DNA, 14 bp, synthetic construct
  source 1..14: mol_type = other DNA
gctcgtgatgaaac

SEQ ID NO: 1065 - DNA, 14 bp, synthetic construct
  source 1..14: mol_type = other DNA
gcacgcgattgtag

SEQ ID NO: 1066 - DNA, 14 bp, synthetic construct
  source 1..14: mol_type = other DNA
acaccaacacattt

SEQ ID NO: 1067 - DNA, 14 bp, synthetic construct
  source 1..14: mol_type = other DNA
gcgagcctcccttc

SEQ ID NO: 1068 - DNA, 14 bp, synthetic construct
  source 1..14: mol_type = other DNA
gttcgtcaccccgc

SEQ ID NO: 1069 - DNA, 14 bp, synthetic construct
  source 1..14: mol_type = other DNA
ataccccgtacatg

SEQ ID NO: 1070 - DNA, 14 bp, synthetic construct
  source 1..14: mol_type = other DNA
cgtccctcgtcgag

SEQ ID NO: 1071 - DNA, 14 bp, synthetic construct
  source 1..14: mol_type = other DNA
ataaaacacccttc

SEQ ID NO: 1072 - DNA, 14 bp, synthetic construct
  source 1..14: mol_type = other DNA
catttgccgcaaca

SEQ ID NO: 1073 - DNA, 14 bp, synthetic construct
  source 1..14: mol_type = other DNA
caactttaacaaac

SEQ ID NO: 1074 - DNA, 14 bp, synthetic construct
  source 1..14: mol_type = other DNA
cggtgctgccatgc

SEQ ID NO: 1075 - DNA, 14 bp, synthetic construct
  source 1..14: mol_type = other DNA
atgcgcattcggag

SEQ ID NO: 1076 - DNA, 14 bp, synthetic construct
  source 1..14: mol_type = other DNA
cacgaatacattga

SEQ ID NO: 1077 - DNA, 14 bp, synthetic construct
  source 1..14: mol_type = other DNA
aacgtcactcagtg

SEQ ID NO: 1078 - DNA, 14 bp, synthetic construct
  source 1..14: mol_type = other DNA
aaattgcaacggtg

SEQ ID NO: 1079 - DNA, 14 bp, synthetic construct
  source 1..14: mol_type = other DNA
gacgacgaacttct

SEQ ID NO: 1080 - DNA, 14 bp, synthetic construct
  source 1..14: mol_type = other DNA
acgtgcctgtgaac

SEQ ID NO: 1081 - DNA, 14 bp, synthetic construct
  source 1..14: mol_type = other DNA
tccgcagctgcgct

SEQ ID NO: 1082 - DNA, 14 bp, synthetic construct
  source 1..14: mol_type = other DNA
agaggttatacgca

SEQ ID NO: 1083 - DNA, 14 bp, synthetic construct
  source 1..14: mol_type = other DNA
aacaaaaatagctt

SEQ ID NO: 1084 - DNA, 14 bp, synthetic construct
  source 1..14: mol_type = other DNA
tgggagatagtcaa

SEQ ID NO: 1085 - DNA, 14 bp, synthetic construct
  source 1..14: mol_type = other DNA
atgcgcgattcacc

SEQ ID NO: 1086 - DNA, 14 bp, synthetic construct
  source 1..14: mol_type = other DNA
gtatagggctcccg

SEQ ID NO: 1087 - DNA, 14 bp, synthetic construct
  source 1..14: mol_type = other DNA
gaccaggcgtattg

SEQ ID NO: 1088 - DNA, 14 bp, synthetic construct
  source 1..14: mol_type = other DNA
accaacctcgcgtt

SEQ ID NO: 1089 - DNA, 14 bp, synthetic construct
  source 1..14: mol_type = other DNA
aacaagtagtgcta

SEQ ID NO: 1090 - DNA, 14 bp, synthetic construct
  source 1..14: mol_type = other DNA
tgtaacaacactaa

SEQ ID NO: 1091 - DNA, 14 bp, synthetic construct
  source 1..14: mol_type = other DNA
tgagtcgaggcata

SEQ ID NO: 1092 - DNA, 14 bp, synthetic construct
  source 1..14: mol_type = other DNA
ccgacaagcttggt

SEQ ID NO: 1093 - DNA, 14 bp, synthetic construct
  source 1..14: mol_type = other DNA
cgttaagccggtgg

SEQ ID NO: 1094 - DNA, 14 bp, synthetic construct
  source 1..14: mol_type = other DNA
ctcccacaagcatt

SEQ ID NO: 1095 - DNA, 14 bp, synthetic construct
  source 1..14: mol_type = other DNA
gggttaagaggtgc

SEQ ID NO: 1096 - DNA, 14 bp, synthetic construct
  source 1..14: mol_type = other DNA
gagcccgtttcccg

SEQ ID NO: 1097 - DNA, 14 bp, synthetic construct
  source 1..14: mol_type = other DNA
accgacgtaatggt

SEQ ID NO: 1098 - DNA, 14 bp, synthetic construct
  source 1..14: mol_type = other DNA
aggcaattgaccgt

SEQ ID NO: 1099 - DNA, 14 bp, synthetic construct
  source 1..14: mol_type = other DNA
atctacccctgagg

SEQ ID NO: 1100 - DNA, 14 bp, synthetic construct
  source 1..14: mol_type = other DNA
gttgaactgcgaga

SEQ ID NO: 1101 - DNA, 14 bp, synthetic construct
  source 1..14: mol_type = other DNA
ggatcgtcatgagc

SEQ ID NO: 1102 - DNA, 14 bp, synthetic construct
  source 1..14: mol_type = other DNA
tgaaaccatgggat

SEQ ID NO: 1103 - DNA, 14 bp, synthetic construct
  source 1..14: mol_type = other DNA
agaccgcgtcgtgt

SEQ ID NO: 1104 - DNA, 14 bp, synthetic construct
  source 1..14: mol_type = other DNA
tagcgagctgccgt

SEQ ID NO: 1105 - DNA, 14 bp, synthetic construct
  source 1..14: mol_type = other DNA
ataaggtacacgtc

SEQ ID NO: 1106 - DNA, 14 bp, synthetic construct
  source 1..14: mol_type = other DNA
gcggcaccactatt

SEQ ID NO: 1107 - DNA, 14 bp, synthetic construct
  source 1..14: mol_type = other DNA
ttggtggggagaac

SEQ ID NO: 1108 - DNA, 14 bp, synthetic construct
  source 1..14: mol_type = other DNA
gctctctaaaggga

SEQ ID NO: 1109 - DNA, 14 bp, synthetic construct
  source 1..14: mol_type = other DNA
ctgtacgtaaaagg

SEQ ID NO: 1110 - DNA, 14 bp, synthetic construct
  source 1..14: mol_type = other DNA
agctcccgaatcgt

SEQ ID NO: 1111 - DNA, 14 bp, synthetic construct
  source 1..14: mol_type = other DNA
aatgtacccgagtc

SEQ ID NO: 1112 - DNA, 14 bp, synthetic construct
  source 1..14: mol_type = other DNA
gcttcgtcgcccag

SEQ ID NO: 1113 - DNA, 14 bp, synthetic construct
  source 1..14: mol_type = other DNA
gtagaagactggtg

SEQ ID NO: 1114 - DNA, 14 bp, synthetic construct
  source 1..14: mol_type = other DNA
ccacatgagattcc

SEQ ID NO: 1115 - DNA, 14 bp, synthetic construct
  source 1..14: mol_type = other DNA
catcttgcgcccac

SEQ ID NO: 1116 - DNA, 14 bp, synthetic construct
  source 1..14: mol_type = other DNA
gccataatctgcgc

SEQ ID NO: 1117 - DNA, 14 bp, synthetic construct
  source 1..14: mol_type = other DNA
cggcctcgatggta

SEQ ID NO: 1118 - DNA, 14 bp, synthetic construct
  source 1..14: mol_type = other DNA
ggtcgtgcgtggac

SEQ ID NO: 1119 - DNA, 14 bp, synthetic construct
  source 1..14: mol_type = other DNA
gactgcctcgtaac

SEQ ID NO: 1120 - DNA, 14 bp, synthetic construct
  source 1..14: mol_type = other DNA
cgcctataaacctg

SEQ ID NO: 1121 - DNA, 14 bp, synthetic construct
  source 1..14: mol_type = other DNA
tgaccctgatcgac

SEQ ID NO: 1122 - DNA, 14 bp, synthetic construct
  source 1..14: mol_type = other DNA
actctcgccgagtg

SEQ ID NO: 1123 - DNA, 14 bp, synthetic construct
  source 1..14: mol_type = other DNA
cggtttcaaccggg

SEQ ID NO: 1124 - DNA, 14 bp, synthetic construct
  source 1..14: mol_type = other DNA
ttgaacgagaaggt

SEQ ID NO: 1125 - DNA, 14 bp, synthetic construct
  source 1..14: mol_type = other DNA
gacggctatacaat

SEQ ID NO: 1126 - DNA, 14 bp, synthetic construct
  source 1..14: mol_type = other DNA
ttgctggcgccgag

SEQ ID NO: 1127 - DNA, 14 bp, synthetic construct
  source 1..14: mol_type = other DNA
acactggcttgacc

SEQ ID NO: 1128 - DNA, 14 bp, synthetic construct
  source 1..14: mol_type = other DNA
actgcactcactaa

SEQ ID NO: 1129 - DNA, 14 bp, synthetic construct
  source 1..14: mol_type = other DNA
aatgctaggtaggg

SEQ ID NO: 1130 - DNA, 14 bp, synthetic construct
  source 1..14: mol_type = other DNA
aataacgattggag

SEQ ID NO: 1131 - DNA, 14 bp, synthetic construct
  source 1..14: mol_type = other DNA
cgcatgtgaggcgt

SEQ ID NO: 1132 - DNA, 14 bp, synthetic construct
  source 1..14: mol_type = other DNA
gccgaggtcgctct

SEQ ID NO: 1133 - DNA, 14 bp, synthetic construct
  source 1..14: mol_type = other DNA
actccagttccagg

SEQ ID NO: 1134 - DNA, 14 bp, synthetic construct
  source 1..14: mol_type = other DNA
catcatgggctgag

SEQ ID NO: 1135 - DNA, 14 bp, synthetic construct
  source 1..14: mol_type = other DNA
gatagacattaacc

SEQ ID NO: 1136 - DNA, 14 bp, synthetic construct
  source 1..14: mol_type = other DNA
tggtggactccaca

SEQ ID NO: 1137 - DNA, 14 bp, synthetic construct
  source 1..14: mol_type = other DNA
cagcaccaatcctt

SEQ ID NO: 1138 - DNA, 14 bp, synthetic construct
  source 1..14: mol_type = other DNA
gacttaagcgtggc

SEQ ID NO: 1139 - DNA, 14 bp, synthetic construct
  source 1..14: mol_type = other DNA
acctacgaagggtt

SEQ ID NO: 1140 - DNA, 14 bp, synthetic construct
  source 1..14: mol_type = other DNA
acctatagtgagag

SEQ ID NO: 1141 - DNA, 14 bp, synthetic construct
  source 1..14: mol_type = other DNA
ctctgcgagtcccg

SEQ ID NO: 1142 - DNA, 14 bp, synthetic construct
  source 1..14: mol_type = other DNA
tcaagacattggga

SEQ ID NO: 1143 - DNA, 14 bp, synthetic construct
  source 1..14: mol_type = other DNA
accctggccgtatc

SEQ ID NO: 1144 - DNA, 14 bp, synthetic construct
  source 1..14: mol_type = other DNA
gtgagtcagtcccg

SEQ ID NO: 1145 - DNA, 14 bp, synthetic construct
  source 1..14: mol_type = other DNA
aagacccgtagctt

SEQ ID NO: 1146 - DNA, 14 bp, synthetic construct
  source 1..14: mol_type = other DNA
gagattgcgtccaa

SEQ ID NO: 1147 - DNA, 14 bp, synthetic construct
  source 1..14: mol_type = other DNA
cgaggttgtgaggg

SEQ ID NO: 1148 - DNA, 14 bp, synthetic construct
  source 1..14: mol_type = other DNA
aggtaaccacttca

SEQ ID NO: 1149 - DNA, 14 bp, synthetic construct
  source 1..14: mol_type = other DNA
ggtagtcatagccc

SEQ ID NO: 1150 - DNA, 14 bp, synthetic construct
  source 1..14: mol_type = other DNA
ggggctagattagc

SEQ ID NO: 1151 - DNA, 14 bp, synthetic construct
  source 1..14: mol_type = other DNA
tgcagattgccggg

SEQ ID NO: 1152 - DNA, 14 bp, synthetic construct
  source 1..14: mol_type = other DNA
acaatgttgcgaga

SEQ ID NO: 1153 - DNA, 14 bp, synthetic construct
  source 1..14: mol_type = other DNA
actagacatacaat

SEQ ID NO: 1154 - DNA, 14 bp, synthetic construct
  source 1..14: mol_type = other DNA
gactctagatagag

SEQ ID NO: 1155 - DNA, 14 bp, synthetic construct
  source 1..14: mol_type = other DNA
gacaaatgaaagtt

SEQ ID NO: 1156 - DNA, 14 bp, synthetic construct
  source 1..14: mol_type = other DNA
caaagagtgataat

SEQ ID NO: 1157 - DNA, 14 bp, synthetic construct
  source 1..14: mol_type = other DNA
catcgtatcggcaa

SEQ ID NO: 1158 - DNA, 14 bp, synthetic construct
  source 1..14: mol_type = other DNA
ccgccactctgtgc

SEQ ID NO: 1159 - DNA, 14 bp, synthetic construct
  source 1..14: mol_type = other DNA
ggcgacgtccaatt

SEQ ID NO: 1160 - DNA, 14 bp, synthetic construct
  source 1..14: mol_type = other DNA
cgaggcctccatat

SEQ ID NO: 1161 - DNA, 14 bp, synthetic construct
  source 1..14: mol_type = other DNA
ccctgtacgtccaa

SEQ ID NO: 1162 - DNA, 14 bp, synthetic construct
  source 1..14: mol_type = other DNA
cgtacctaaacgtc

SEQ ID NO: 1163 - DNA, 14 bp, synthetic construct
  source 1..14: mol_type = other DNA
ggtgagcgcacttg

SEQ ID NO: 1164 - DNA, 14 bp, synthetic construct
  source 1..14: mol_type = other DNA
cttatgcgccagag

SEQ ID NO: 1165 - DNA, 14 bp, synthetic construct
  source 1..14: mol_type = other DNA
atcgaacgctataa

SEQ ID NO: 1166 - DNA, 14 bp, synthetic construct
  source 1..14: mol_type = other DNA
cggtgatagtcgag

SEQ ID NO: 1167 - DNA, 14 bp, synthetic construct
  source 1..14: mol_type = other DNA
tccccactgggtac

SEQ ID NO: 1168 - DNA, 14 bp, synthetic construct
  source 1..14: mol_type = other DNA
tgaatcactagaca

SEQ ID NO: 1169 - DNA, 14 bp, synthetic construct
  source 1..14: mol_type = other DNA
aaacgtcgctctaa

SEQ ID NO: 1170 - DNA, 14 bp, synthetic construct
  source 1..14: mol_type = other DNA
tagagagtcatcga

SEQ ID NO: 1171 - DNA, 14 bp, synthetic construct
  source 1..14: mol_type = other DNA
agtggtcgtgccaa

SEQ ID NO: 1172 - DNA, 14 bp, synthetic construct
  source 1..14: mol_type = other DNA
ataccgggtgtggg

SEQ ID NO: 1173 - DNA, 14 bp, synthetic construct
  source 1..14: mol_type = other DNA
ccagtagcccatgt

SEQ ID NO: 1174 - DNA, 14 bp, synthetic construct
  source 1..14: mol_type = other DNA
gtcccggaaattga

SEQ ID NO: 1175 - DNA, 14 bp, synthetic construct
  source 1..14: mol_type = other DNA
aagtggaggctgta

SEQ ID NO: 1176 - DNA, 14 bp, synthetic construct
  source 1..14: mol_type = other DNA
gtagagtagatagc

SEQ ID NO: 1177 - DNA, 14 bp, synthetic construct
  source 1..14: mol_type = other DNA
gtcagctgcgccct

SEQ ID NO: 1178 - DNA, 14 bp, synthetic construct
  source 1..14: mol_type = other DNA
acgttctaacgcag

SEQ ID NO: 1179 - DNA, 14 bp, synthetic construct
  source 1..14: mol_type = other DNA
cggaccccactttc

SEQ ID NO: 1180 - DNA, 14 bp, synthetic construct
  source 1..14: mol_type = other DNA
ggcttgagatgaag

SEQ ID NO: 1181 - DNA, 14 bp, synthetic construct
  source 1..14: mol_type = other DNA
cgttactacgaccc

SEQ ID NO: 1182 - DNA, 14 bp, synthetic construct
  source 1..14: mol_type = other DNA
tgcgtggcaggact

SEQ ID NO: 1183 - DNA, 14 bp, synthetic construct
  source 1..14: mol_type = other DNA
tcatggctcagcaa

SEQ ID NO: 1184 - DNA, 14 bp, synthetic construct
  source 1..14: mol_type = other DNA
gccgtcaacctcat

SEQ ID NO: 1185 - DNA, 14 bp, synthetic construct
  source 1..14: mol_type = other DNA
tctccgtaaggcag

SEQ ID NO: 1186 - DNA, 14 bp, synthetic construct
  source 1..14: mol_type = other DNA
ccgtgccgcaactt

SEQ ID NO: 1187 - DNA, 14 bp, synthetic construct
  source 1..14: mol_type = other DNA
gttacatgcacgga

SEQ ID NO: 1188 - DNA, 14 bp, synthetic construct
  source 1..14: mol_type = other DNA
gacgagtagatgat

SEQ ID NO: 1189 - DNA, 14 bp, synthetic construct
  source 1..14: mol_type = other DNA
taggtaaagccgat

SEQ ID NO: 1190 - DNA, 14 bp, synthetic construct
  source 1..14: mol_type = other DNA
aatatggctacggg

SEQ ID NO: 1191 - DNA, 14 bp, synthetic construct
  source 1..14: mol_type = other DNA
gtggcgtcggtcga

SEQ ID NO: 1192 - DNA, 14 bp, synthetic construct
  source 1..14: mol_type = other DNA
gcatgactcaggct

SEQ ID NO: 1193 - DNA, 14 bp, synthetic construct
  source 1..14: mol_type = other DNA
cgtgaccagacttc

SEQ ID NO: 1194 - DNA, 14 bp, synthetic construct
  source 1..14: mol_type = other DNA
aactactcaaactg

SEQ ID NO: 1195 - DNA, 14 bp, synthetic construct
  source 1..14: mol_type = other DNA
tagggacgatgagt

SEQ ID NO: 1196 - DNA, 14 bp, synthetic construct
  source 1..14: mol_type = other DNA
tggataatagcaaa

SEQ ID NO: 1197 - DNA, 14 bp, synthetic construct
  source 1..14: mol_type = other DNA
tggatctcaagaag

SEQ ID NO: 1198 - DNA, 14 bp, synthetic construct
  source 1..14: mol_type = other DNA
gggtatcagtaggg

SEQ ID NO: 1199 - DNA, 14 bp, synthetic construct
  source 1..14: mol_type = other DNA
tcacctcgcatgaa

SEQ ID NO: 1200 - DNA, 14 bp, synthetic construct
  source 1..14: mol_type = other DNA
catgggacgggtat

SEQ ID NO: 1201 - DNA, 14 bp, synthetic construct
  source 1..14: mol_type = other DNA
agagttgagctccc

SEQ ID NO: 1202 - DNA, 14 bp, synthetic construct
  source 1..14: mol_type = other DNA
caccaaattcagct

SEQ ID NO: 1203 - DNA, 14 bp, synthetic construct
  source 1..14: mol_type = other DNA
tgatccccactccc

SEQ ID NO: 1204 - DNA, 14 bp, synthetic construct
  source 1..14: mol_type = other DNA
atatccatcagagg

SEQ ID NO: 1205 - DNA, 14 bp, synthetic construct
  source 1..14: mol_type = other DNA
caatccagtcctca

SEQ ID NO: 1206 - DNA, 14 bp, synthetic construct
  source 1..14: mol_type = other DNA
agtgtacgccggtg

SEQ ID NO: 1207 - DNA, 14 bp, synthetic construct
  source 1..14: mol_type = other DNA
tggacctgccctaa

SEQ ID NO: 1208 - DNA, 14 bp, synthetic construct
  source 1..14: mol_type = other DNA
caaaattagatcgc

SEQ ID NO: 1209 - DNA, 14 bp, synthetic construct
  source 1..14: mol_type = other DNA
ggtatggggatgag

SEQ ID NO: 1210 - DNA, 14 bp, synthetic construct
  source 1..14: mol_type = other DNA
gatacgagatatac

SEQ ID NO: 1211 - DNA, 14 bp, synthetic construct
  source 1..14: mol_type = other DNA
cagcacagtacttg

SEQ ID NO: 1212 - DNA, 14 bp, synthetic construct
  source 1..14: mol_type = other DNA
atcccctgaatccc

SEQ ID NO: 1213 - DNA, 14 bp, synthetic construct
  source 1..14: mol_type = other DNA
cattgaggactgcc

SEQ ID NO: 1214 - DNA, 14 bp, synthetic construct
  source 1..14: mol_type = other DNA
gcggtgctacctgg

SEQ ID NO: 1215 - DNA, 14 bp, synthetic construct
  source 1..14: mol_type = other DNA
catagtcctcaaag

SEQ ID NO: 1216 - DNA, 14 bp, synthetic construct
  source 1..14: mol_type = other DNA
cctgcatgcgcgtg

SEQ ID NO: 1217 - DNA, 14 bp, synthetic construct
  source 1..14: mol_type = other DNA
ccggtgcaaccatt

SEQ ID NO: 1218 - DNA, 14 bp, synthetic construct
  source 1..14: mol_type = other DNA
cggaagttgatcag

SEQ ID NO: 1219 - DNA, 14 bp, synthetic construct
  source 1..14: mol_type = other DNA
gaatctactaaccc

SEQ ID NO: 1220 - DNA, 14 bp, synthetic construct
  source 1..14: mol_type = other DNA
gactcccactatac

SEQ ID NO: 1221 - DNA, 14 bp, synthetic construct
  source 1..14: mol_type = other DNA
ggtctcaaatcgac

SEQ ID NO: 1222 - DNA, 14 bp, synthetic construct
  source 1..14: mol_type = other DNA
ttgggactagggca

SEQ ID NO: 1223 - DNA, 14 bp, synthetic construct
  source 1..14: mol_type = other DNA
tcctgcgctaccac

SEQ ID NO: 1224 - DNA, 14 bp, synthetic construct
  source 1..14: mol_type = other DNA
tcacgtccgccata

SEQ ID NO: 1225 - DNA, 14 bp, synthetic construct
  source 1..14: mol_type = other DNA
gcccagacgttggt

SEQ ID NO: 1226 - DNA, 14 bp, synthetic construct
  source 1..14: mol_type = other DNA
tcacgttcccaacc

SEQ ID NO: 1227 - DNA, 14 bp, synthetic construct
  source 1..14: mol_type = other DNA
cagtggaagcgtct

SEQ ID NO: 1228 - DNA, 14 bp, synthetic construct
  source 1..14: mol_type = other DNA
aacactgtggggtg

SEQ ID NO: 1229 - DNA, 14 bp, synthetic construct
  source 1..14: mol_type = other DNA
actatgtggggacc

SEQ ID NO: 1230 - DNA, 14 bp, synthetic construct
  source 1..14: mol_type = other DNA
tatgtcaaccggcg

SEQ ID NO: 1231 - DNA, 14 bp, synthetic construct
  source 1..14: mol_type = other DNA
gcctgtacaaaact

SEQ ID NO: 1232 - DNA, 14 bp, synthetic construct
  source 1..14: mol_type = other DNA
cttccagatgcaac

SEQ ID NO: 1233 - DNA, 14 bp, synthetic construct
  source 1..14: mol_type = other DNA
cccaagattaaact

SEQ ID NO: 1234 - DNA, 14 bp, synthetic construct
  source 1..14: mol_type = other DNA
cttagtaacaagcg

SEQ ID NO: 1235 - DNA, 14 bp, synthetic construct
  source 1..14: mol_type = other DNA
cacttcaaccctcc

SEQ ID NO: 1236 - DNA, 14 bp, synthetic construct
  source 1..14: mol_type = other DNA
aattaccgtggcaa

SEQ ID NO: 1237 - DNA, 14 bp, synthetic construct
  source 1..14: mol_type = other DNA
agctacataaatgg

SEQ ID NO: 1238 - DNA, 14 bp, synthetic construct
  source 1..14: mol_type = other DNA
tcaggcgatgacta

SEQ ID NO: 1239 - DNA, 14 bp, synthetic construct
  source 1..14: mol_type = other DNA
agtatgtcccgcag

SEQ ID NO: 1240 - DNA, 14 bp, synthetic construct
  source 1..14: mol_type = other DNA
agaactctgggagt

SEQ ID NO: 1241 - DNA, 14 bp, synthetic construct
  source 1..14: mol_type = other DNA
atcctgaccgtggg

SEQ ID NO: 1242 - DNA, 14 bp, synthetic construct
  source 1..14: mol_type = other DNA
ctgacatgcatgag

SEQ ID NO: 1243 - DNA, 14 bp, synthetic construct
  source 1..14: mol_type = other DNA
cagaaaagttccct

SEQ ID NO: 1244 - DNA, 14 bp, synthetic construct
  source 1..14: mol_type = other DNA
cagtatcgatcgga

SEQ ID NO: 1245 - DNA, 14 bp, synthetic construct
  source 1..14: mol_type = other DNA
ctccgacaactgct

SEQ ID NO: 1246 - DNA, 14 bp, synthetic construct
  source 1..14: mol_type = other DNA
ccacgagattgagt

SEQ ID NO: 1247 - DNA, 14 bp, synthetic construct
  source 1..14: mol_type = other DNA
tcgtcgccgacctg

SEQ ID NO: 1248 - DNA, 14 bp, synthetic construct
  source 1..14: mol_type = other DNA
tcgggctcgtgggc

SEQ ID NO: 1249 - DNA, 14 bp, synthetic construct
  source 1..14: mol_type = other DNA
aggacgggtaattg

SEQ ID NO: 1250 - DNA, 14 bp, synthetic construct
  source 1..14: mol_type = other DNA
agtatgaagtagga

SEQ ID NO: 1251 - DNA, 14 bp, synthetic construct
  source 1..14: mol_type = other DNA
tcttaagagacacc

SEQ ID NO: 1252 - DNA, 14 bp, synthetic construct
  source 1..14: mol_type = other DNA
gcgcgacttgagct

SEQ ID NO: 1253 - DNA, 14 bp, synthetic construct
  source 1..14: mol_type = other DNA
attgctccggagca

SEQ ID NO: 1254 - DNA, 14 bp, synthetic construct
  source 1..14: mol_type = other DNA
gtcgtgcggagggt

SEQ ID NO: 1255 - DNA, 14 bp, synthetic construct
  source 1..14: mol_type = other DNA
atggctaccgtcgg

SEQ ID NO: 1256 - DNA, 14 bp, synthetic construct
  source 1..14: mol_type = other DNA
aggatcggtggatg

SEQ ID NO: 1257 - DNA, 14 bp, synthetic construct
  source 1..14: mol_type = other DNA
caaactcggtcgtg

SEQ ID NO: 1258 - DNA, 14 bp, synthetic construct
  source 1..14: mol_type = other DNA
ggcgctagcatcct

SEQ ID NO: 1259 - DNA, 14 bp, synthetic construct
  source 1..14: mol_type = other DNA
agagaagaaatatt

SEQ ID NO: 1260 - DNA, 14 bp, synthetic construct
  source 1..14: mol_type = other DNA
cgttgggacgtaga

SEQ ID NO: 1261 - DNA, 14 bp, synthetic construct
  source 1..14: mol_type = other DNA
ggaacgtcccctta

SEQ ID NO: 1262 - DNA, 14 bp, synthetic construct
  source 1..14: mol_type = other DNA
cggtgctggaggta

SEQ ID NO: 1263 - DNA, 14 bp, synthetic construct
  source 1..14: mol_type = other DNA
gggtaacaggactt

SEQ ID NO: 1264 - DNA, 14 bp, synthetic construct
  source 1..14: mol_type = other DNA
acctctctgcacgg

SEQ ID NO: 1265 - DNA, 14 bp, synthetic construct
  source 1..14: mol_type = other DNA
cacggtaactcgtg

SEQ ID NO: 1266 - DNA, 14 bp, synthetic construct
  source 1..14: mol_type = other DNA
gtctagcatggagg

SEQ ID NO: 1267 - DNA, 14 bp, synthetic construct
  source 1..14: mol_type = other DNA
atcgtccgagcggt

SEQ ID NO: 1268 - DNA, 14 bp, synthetic construct
  source 1..14: mol_type = other DNA
gtgcgaatactgcc

SEQ ID NO: 1269 - DNA, 14 bp, synthetic construct
  source 1..14: mol_type = other DNA
catcctaggctcga

SEQ ID NO: 1270 - DNA, 14 bp, synthetic construct
  source 1..14: mol_type = other DNA
ctgaacgaatctcg

SEQ ID NO: 1271 - DNA, 14 bp, synthetic construct
  source 1..14: mol_type = other DNA
tatgtaagaaccaa

SEQ ID NO: 1272 - DNA, 14 bp, synthetic construct
  source 1..14: mol_type = other DNA
ctgaaaagatctac

SEQ ID NO: 1273 - DNA, 14 bp, synthetic construct
  source 1..14: mol_type = other DNA
agattaccccgtaa

SEQ ID NO: 1274 - DNA, 14 bp, synthetic construct
  source 1..14: mol_type = other DNA
gatcgcgatatagc

SEQ ID NO: 1275 - DNA, 14 bp, synthetic construct
  source 1..14: mol_type = other DNA
gccaccgagattgt

SEQ ID NO: 1276 - DNA, 14 bp, synthetic construct
  source 1..14: mol_type = other DNA
ggtatcagatgaca

SEQ ID NO: 1277 - DNA, 14 bp, synthetic construct
  source 1..14: mol_type = other DNA
cggtggcatcctga

SEQ ID NO: 1278 - DNA, 14 bp, synthetic construct
  source 1..14: mol_type = other DNA
tactaacgagtgaa

SEQ ID NO: 1279 - DNA, 14 bp, synthetic construct
  source 1..14: mol_type = other DNA
tccgctcccagtgg

SEQ ID NO: 1280 - DNA, 14 bp, synthetic construct
  source 1..14: mol_type = other DNA
agatagagttgaga

SEQ ID NO: 1281 - DNA, 14 bp, synthetic construct
  source 1..14: mol_type = other DNA
taatgcacggtgcg

SEQ ID NO: 1282 - DNA, 14 bp, synthetic construct
  source 1..14: mol_type = other DNA
tcgttcaaacaacc

SEQ ID NO: 1283 - DNA, 14 bp, synthetic construct
  source 1..14: mol_type = other DNA
taggaactaggatc

SEQ ID NO: 1284 - DNA, 14 bp, synthetic construct
  source 1..14: mol_type = other DNA
ctcgttcgacagaa

SEQ ID NO: 1285 - DNA, 14 bp, synthetic construct
  source 1..14: mol_type = other DNA
cgggactggatgat

SEQ ID NO: 1286 - DNA, 14 bp, synthetic construct
  source 1..14: mol_type = other DNA
actgtgccatgccg

SEQ ID NO: 1287 - DNA, 14 bp, synthetic construct
  source 1..14: mol_type = other DNA
gtttacgcgaaaag

SEQ ID NO: 1288 - DNA, 14 bp, synthetic construct
  source 1..14: mol_type = other DNA
gcttcccacttgca

SEQ ID NO: 1289 - DNA, 14 bp, synthetic construct
  source 1..14: mol_type = other DNA
gaacaagtctttcg

SEQ ID NO: 1290 - DNA, 14 bp, synthetic construct
  source 1..14: mol_type = other DNA
atgcatcaatatgg

SEQ ID NO: 1291 - DNA, 14 bp, synthetic construct
  source 1..14: mol_type = other DNA
agcattatgtacgc

SEQ ID NO: 1292 - DNA, 14 bp, synthetic construct
  source 1..14: mol_type = other DNA
aatagatcacgttc

SEQ ID NO: 1293 - DNA, 14 bp, synthetic construct
  source 1..14: mol_type = other DNA
cggataatcttccg

SEQ ID NO: 1294 - DNA, 14 bp, synthetic construct
  source 1..14: mol_type = other DNA
aacattacgggtgt

SEQ ID NO: 1295 - DNA, 14 bp, synthetic construct
  source 1..14: mol_type = other DNA
tcacatatgcatca

SEQ ID NO: 1296 - DNA, 14 bp, synthetic construct
  source 1..14: mol_type = other DNA
agtctggccttggc

SEQ ID NO: 1297 - DNA, 14 bp, synthetic construct
  source 1..14: mol_type = other DNA
attaaagtagcggt

SEQ ID NO: 1298 - DNA, 14 bp, synthetic construct
  source 1..14: mol_type = other DNA
atcattccccatac

SEQ ID NO: 1299 - DNA, 14 bp, synthetic construct
  source 1..14: mol_type = other DNA
tctcgcccatctag

SEQ ID NO: 1300 - DNA, 14 bp, synthetic construct
  source 1..14: mol_type = other DNA
atcacgtgatcagt

SEQ ID NO: 1301 - DNA, 14 bp, synthetic construct
  source 1..14: mol_type = other DNA
gataaacacattat

SEQ ID NO: 1302 - DNA, 14 bp, synthetic construct
  source 1..14: mol_type = other DNA
atcaaactgcatta

SEQ ID NO: 1303 - DNA, 14 bp, synthetic construct
  source 1..14: mol_type = other DNA
gaggtatcctccat

SEQ ID NO: 1304 - DNA, 14 bp, synthetic construct
  source 1..14: mol_type = other DNA
agaatttgcgagct

SEQ ID NO: 1305 - DNA, 14 bp, synthetic construct
  source 1..14: mol_type = other DNA
gctaagttccgtcc

SEQ ID NO: 1306 - DNA, 14 bp, synthetic construct
  source 1..14: mol_type = other DNA
agcggttcaatctg

SEQ ID NO: 1307 - DNA, 14 bp, synthetic construct
  source 1..14: mol_type = other DNA
gattgggatgctac

SEQ ID NO: 1308 - DNA, 14 bp, synthetic construct
  source 1..14: mol_type = other DNA
gagtactatgtcca

SEQ ID NO: 1309 - DNA, 14 bp, synthetic construct
  source 1..14: mol_type = other DNA
gttaccaaccttca

SEQ ID NO: 1310 - DNA, 14 bp, synthetic construct
  source 1..14: mol_type = other DNA
tccacctttcagag

SEQ ID NO: 1311 - DNA, 14 bp, synthetic construct
  source 1..14: mol_type = other DNA
tgaaactatctaaa

SEQ ID NO: 1312 - DNA, 14 bp, synthetic construct
  source 1..14: mol_type = other DNA
ggaatatactatac

SEQ ID NO: 1313 - DNA, 14 bp, synthetic construct
  source 1..14: mol_type = other DNA
tatgggtaatgaga

SEQ ID NO: 1314 - DNA, 14 bp, synthetic construct
  source 1..14: mol_type = other DNA
cttgctggacaggt

SEQ ID NO: 1315 - DNA, 14 bp, synthetic construct
  source 1..14: mol_type = other DNA
ttcatcgtcaggac

SEQ ID NO: 1316 - DNA, 14 bp, synthetic construct
  source 1..14: mol_type = other DNA
gtgtgaatgtccaa

SEQ ID NO: 1317 - DNA, 14 bp, synthetic construct
  source 1..14: mol_type = other DNA
gtaaacctagttga

SEQ ID NO: 1318 - DNA, 14 bp, synthetic construct
  source 1..14: mol_type = other DNA
gtgtcgtacgagtg

SEQ ID NO: 1319 - DNA, 14 bp, synthetic construct
  source 1..14: mol_type = other DNA
gcttaagtccgctc

SEQ ID NO: 1320 - DNA, 14 bp, synthetic construct
  source 1..14: mol_type = other DNA
gtcttggcgtcggc

SEQ ID NO: 1321 - DNA, 14 bp, synthetic construct
  source 1..14: mol_type = other DNA
aaatgcgctcttag

SEQ ID NO: 1322 - DNA, 14 bp, synthetic construct
  source 1..14: mol_type = other DNA
cggtcgactggtta

SEQ ID NO: 1323 - DNA, 14 bp, synthetic construct
  source 1..14: mol_type = other DNA
tagggctaaattgg

SEQ ID NO: 1324 - DNA, 14 bp, synthetic construct
  source 1..14: mol_type = other DNA
ttgacgggctgggt

SEQ ID NO: 1325 - DNA, 14 bp, synthetic construct
  source 1..14: mol_type = other DNA
ctaaagcactttcc

SEQ ID NO: 1326 - DNA, 14 bp, synthetic construct
  source 1..14: mol_type = other DNA
acaagttcaaaatt

SEQ ID NO: 1327 - DNA, 14 bp, synthetic construct
  source 1..14: mol_type = other DNA
tcatagattgcccc

SEQ ID NO: 1328 - DNA, 14 bp, synthetic construct
  source 1..14: mol_type = other DNA
cgtccggcatgtct

SEQ ID NO: 1329 - DNA, 14 bp, synthetic construct
  source 1..14: mol_type = other DNA
ttctaaaagcatcg

SEQ ID NO: 1330 - DNA, 14 bp, synthetic construct
  source 1..14: mol_type = other DNA
cgtgcagattggtc

SEQ ID NO: 1331 - DNA, 14 bp, synthetic construct
  source 1..14: mol_type = other DNA
aattcgttaccaaa

SEQ ID NO: 1332 - DNA, 14 bp, synthetic construct
  source 1..14: mol_type = other DNA
taaacggtggcatt

SEQ ID NO: 1333 - DNA, 14 bp, synthetic construct
  source 1..14: mol_type = other DNA
aacagtgaataatt

SEQ ID NO: 1334 - DNA, 14 bp, synthetic construct
  source 1..14: mol_type = other DNA
ctatacgttacggc

SEQ ID NO: 1335 - DNA, 14 bp, synthetic construct
  source 1..14: mol_type = other DNA
tcacggtctgcagt

SEQ ID NO: 1336 - DNA, 14 bp, synthetic construct
  source 1..14: mol_type = other DNA
atcgcctcacatta

SEQ ID NO: 1337 - DNA, 14 bp, synthetic construct
  source 1..14: mol_type = other DNA
taaaaatgatgggt

SEQ ID NO: 1338 - DNA, 14 bp, synthetic construct
  source 1..14: mol_type = other DNA
gatgtaactacgat

SEQ ID NO: 1339 - DNA, 14 bp, synthetic construct
  source 1..14: mol_type = other DNA
tagagattgtaaag

SEQ ID NO: 1340 - DNA, 14 bp, synthetic construct
  source 1..14: mol_type = other DNA
tgcgactgtatcac

SEQ ID NO: 1341 - DNA, 14 bp, synthetic construct
  source 1..14: mol_type = other DNA
gacccacttataat

SEQ ID NO: 1342 - DNA, 14 bp, synthetic construct
  source 1..14: mol_type = other DNA
tcgaagcatagatt

SEQ ID NO: 1343 - DNA, 14 bp, synthetic construct
  source 1..14: mol_type = other DNA
gtaaaggttccggt

SEQ ID NO: 1344 - DNA, 14 bp, synthetic construct
  source 1..14: mol_type = other DNA
ggcgtcattcgcct

SEQ ID NO: 1345 - DNA, 14 bp, synthetic construct
  source 1..14: mol_type = other DNA
tcaatagcctagtc

SEQ ID NO: 1346 - DNA, 14 bp, synthetic construct
  source 1..14: mol_type = other DNA
catttatccaacgc

SEQ ID NO: 1347 - DNA, 14 bp, synthetic construct
  source 1..14: mol_type = other DNA
cccattcggatcgt

SEQ ID NO: 1348 - DNA, 14 bp, synthetic construct
  source 1..14: mol_type = other DNA
gcatcttaacgtac

SEQ ID NO: 1349 - DNA, 14 bp, synthetic construct
  source 1..14: mol_type = other DNA
ggctttcccccgta

SEQ ID NO: 1350 - DNA, 14 bp, synthetic construct
  source 1..14: mol_type = other DNA
ccgtggtctatggg

SEQ ID NO: 1351 - DNA, 14 bp, synthetic construct
  source 1..14: mol_type = other DNA
aatttactcgcgga

SEQ ID NO: 1352 - DNA, 14 bp, synthetic construct
  source 1..14: mol_type = other DNA
tacctcggtggcct

SEQ ID NO: 1353 - DNA, 14 bp, synthetic construct
  source 1..14: mol_type = other DNA
tcccccacacttta

SEQ ID NO: 1354 - DNA, 14 bp, synthetic construct
  source 1..14: mol_type = other DNA
cccttgcgtgtacc

SEQ ID NO: 1355 - DNA, 14 bp, synthetic construct
  source 1..14: mol_type = other DNA
attaacgtctcaca

SEQ ID NO: 1356 - DNA, 14 bp, synthetic construct
  source 1..14: mol_type = other DNA
gcctttcgtacgac

SEQ ID NO: 1357 - DNA, 14 bp, synthetic construct
  source 1..14: mol_type = other DNA
gcatattgtaccga

SEQ ID NO: 1358 - DNA, 14 bp, synthetic construct
  source 1..14: mol_type = other DNA
tgatttagcacgga

SEQ ID NO: 1359 - DNA, 14 bp, synthetic construct
  source 1..14: mol_type = other DNA
aggttagtacacta

SEQ ID NO: 1360 - DNA, 14 bp, synthetic construct
  source 1..14: mol_type = other DNA
tgcgctccctgcta

SEQ ID NO: 1361 - DNA, 14 bp, synthetic construct
  source 1..14: mol_type = other DNA
tacaagttcaaagt

SEQ ID NO: 1362 - DNA, 14 bp, synthetic construct
  source 1..14: mol_type = other DNA
atggctggcccttg

SEQ ID NO: 1363 - DNA, 14 bp, synthetic construct
  source 1..14: mol_type = other DNA
cgcctaagatgtta

SEQ ID NO: 1364 - DNA, 14 bp, synthetic construct
  source 1..14: mol_type = other DNA
gtgcccactccctt

SEQ ID NO: 1365 - DNA, 14 bp, synthetic construct
  source 1..14: mol_type = other DNA
gaagtgttagcgta

SEQ ID NO: 1366 - DNA, 14 bp, synthetic construct
  source 1..14: mol_type = other DNA
tagcgtccttgagc

SEQ ID NO: 1367 - DNA, 14 bp, synthetic construct
  source 1..14: mol_type = other DNA
acgctctcggttga

SEQ ID NO: 1368 - DNA, 14 bp, synthetic construct
  source 1..14: mol_type = other DNA
gcgttcttgggagg

SEQ ID NO: 1369 - DNA, 14 bp, synthetic construct
  source 1..14: mol_type = other DNA
atctgtcaaagagt

SEQ ID NO: 1370 - DNA, 14 bp, synthetic construct
  source 1..14: mol_type = other DNA
ctatccagaaatgt

SEQ ID NO: 1371 - DNA, 14 bp, synthetic construct
  source 1..14: mol_type = other DNA
caatgaccagtttg

SEQ ID NO: 1372 - DNA, 14 bp, synthetic construct
  source 1..14: mol_type = other DNA
agcatgtcggaatt

SEQ ID NO: 1373 - DNA, 14 bp, synthetic construct
  source 1..14: mol_type = other DNA
aagtggatagcttc

SEQ ID NO: 1374 - DNA, 14 bp, synthetic construct
  source 1..14: mol_type = other DNA
ttcagcttgagagg

SEQ ID NO: 1375 - DNA, 14 bp, synthetic construct
  source 1..14: mol_type = other DNA
gaattctgagatgg

SEQ ID NO: 1376 - DNA, 14 bp, synthetic construct
  source 1..14: mol_type = other DNA
agtaggtcaactat

SEQ ID NO: 1377 - DNA, 14 bp, synthetic construct
  source 1..14: mol_type = other DNA
cgcttgctgagcat

SEQ ID NO: 1378 - DNA, 14 bp, synthetic construct
  source 1..14: mol_type = other DNA
accttattgcagaa

SEQ ID NO: 1379 - DNA, 14 bp, synthetic construct
  source 1..14: mol_type = other DNA
gtgggcaatagtat

SEQ ID NO: 1380 - DNA, 14 bp, synthetic construct
  source 1..14: mol_type = other DNA
tactactacatccc

SEQ ID NO: 1381 - DNA, 14 bp, synthetic construct
  source 1..14: mol_type = other DNA
tggttcgagcacat

SEQ ID NO: 1382 - DNA, 14 bp, synthetic construct
  source 1..14: mol_type = other DNA
ggtcttcaatgacg

SEQ ID NO: 1383 - DNA, 14 bp, synthetic construct
  source 1..14: mol_type = other DNA
attcagacatcgct

SEQ ID NO: 1384 - DNA, 14 bp, synthetic construct
  source 1..14: mol_type = other DNA
ggggctcaaccttt

SEQ ID NO: 1385 - DNA, 14 bp, synthetic construct
  source 1..14: mol_type = other DNA
aacgactttaaact

SEQ ID NO: 1386 - DNA, 14 bp, synthetic construct
  source 1..14: mol_type = other DNA
atgatagtctaagc

SEQ ID NO: 1387 - DNA, 14 bp, synthetic construct
  source 1..14: mol_type = other DNA
gtaccaccgcttta

SEQ ID NO: 1388 - DNA, 14 bp, synthetic construct
  source 1..14: mol_type = other DNA
ggaactttcggtaa

SEQ ID NO: 1389 - DNA, 14 bp, synthetic construct
  source 1..14: mol_type = other DNA
ggcaagtgtatctg

SEQ ID NO: 1390 - DNA, 14 bp, synthetic construct
  source 1..14: mol_type = other DNA
gttcgcatgatacg

SEQ ID NO: 1391 - DNA, 14 bp, synthetic construct
  source 1..14: mol_type = other DNA
aggaccctctattg

SEQ ID NO: 1392 - DNA, 14 bp, synthetic construct
  source 1..14: mol_type = other DNA
agttatccgtaccg

SEQ ID NO: 1393 - DNA, 14 bp, synthetic construct
  source 1..14: mol_type = other DNA
gcactcgcggtatt

SEQ ID NO: 1394 - DNA, 14 bp, synthetic construct
  source 1..14: mol_type = other DNA
ctgcccgatgttag

SEQ ID NO: 1395 - DNA, 14 bp, synthetic construct
  source 1..14: mol_type = other DNA
atactgatccgcct

SEQ ID NO: 1396 - DNA, 14 bp, synthetic construct
  source 1..14: mol_type = other DNA
agatttgtaggaac

SEQ ID NO: 1397 - DNA, 14 bp, synthetic construct
  source 1..14: mol_type = other DNA
gagtcgctgtatgc

SEQ ID NO: 1398 - DNA, 14 bp, synthetic construct
  source 1..14: mol_type = other DNA
cggttatcgagatc

SEQ ID NO: 1399 - DNA, 14 bp, synthetic construct
  source 1..14: mol_type = other DNA
tcgagcggctgtat

SEQ ID NO: 1400 - DNA, 14 bp, synthetic construct
  source 1..14: mol_type = other DNA
acgctgttaaacat

SEQ ID NO: 1401 - DNA, 14 bp, synthetic construct
  source 1..14: mol_type = other DNA
ccgtttacgatgcg

SEQ ID NO: 1402 - DNA, 14 bp, synthetic construct
  source 1..14: mol_type = other DNA
cttgtgacctccgc

SEQ ID NO: 1403 - DNA, 14 bp, synthetic construct
  source 1..14: mol_type = other DNA
aaagtattgacatc

SEQ ID NO: 1404 - DNA, 14 bp, synthetic construct
  source 1..14: mol_type = other DNA
gtgatgaggtgcgt

SEQ ID NO: 1405 - DNA, 14 bp, synthetic construct
  source 1..14: mol_type = other DNA
tatagcgtacggct

SEQ ID NO: 1406 - DNA, 14 bp, synthetic construct
  source 1..14: mol_type = other DNA
cctctaatatcgcc

SEQ ID NO: 1407 - DNA, 14 bp, synthetic construct
  source 1..14: mol_type = other DNA
gtttggtccgacca

SEQ ID NO: 1408 - DNA, 14 bp, synthetic construct
  source 1..14: mol_type = other DNA
cttagcaatcaggt

SEQ ID NO: 1409 - DNA, 14 bp, synthetic construct
  source 1..14: mol_type = other DNA
tatcaggctcatac

SEQ ID NO: 1410 - DNA, 14 bp, synthetic construct
  source 1..14: mol_type = other DNA
ctgaacctaggctt

SEQ ID NO: 1411 - DNA, 14 bp, synthetic construct
  source 1..14: mol_type = other DNA
acgttgagtgctga

SEQ ID NO: 1412 - DNA, 14 bp, synthetic construct
  source 1..14: mol_type = other DNA
cagttcaactggtc

SEQ ID NO: 1413 - DNA, 14 bp, synthetic construct
  source 1..14: mol_type = other DNA
gtctatactcccgc

SEQ ID NO: 1414 - DNA, 14 bp, synthetic construct
  source 1..14: mol_type = other DNA
ccgattggcctgtg

SEQ ID NO: 1415 - DNA, 14 bp, synthetic construct
  source 1..14: mol_type = other DNA
attcggtaccccct

SEQ ID NO: 1416 - DNA, 14 bp, synthetic construct
  source 1..14: mol_type = other DNA
tcatatcatgaggc

SEQ ID NO: 1417 - DNA, 14 bp, synthetic construct
  source 1..14: mol_type = other DNA
catgtgttcgcccg

SEQ ID NO: 1418 - DNA, 14 bp, synthetic construct
  source 1..14: mol_type = other DNA
cgattatcccggct

SEQ ID NO: 1419 - DNA, 14 bp, synthetic construct
  source 1..14: mol_type = other DNA
gccatatataactg

SEQ ID NO: 1420 - DNA, 14 bp, synthetic construct
  source 1..14: mol_type = other DNA
aattgatagtagga

SEQ ID NO: 1421 - DNA, 14 bp, synthetic construct
  source 1..14: mol_type = other DNA
agttcagtggatgg

SEQ ID NO: 1422 - DNA, 14 bp, synthetic construct
  source 1..14: mol_type = other DNA
caatgggtgagtgt

SEQ ID NO: 1423 - DNA, 14 bp, synthetic construct
  source 1..14: mol_type = other DNA
gatctaatgcgtac

SEQ ID NO: 1424 - DNA, 14 bp, synthetic construct
  source 1..14: mol_type = other DNA
tagcaggcgtctgt

SEQ ID NO: 1425 - DNA, 14 bp, synthetic construct
  source 1..14: mol_type = other DNA
tagacttctaaggg

SEQ ID NO: 1426 - DNA, 14 bp, synthetic construct
  source 1..14: mol_type = other DNA
ttcggctcctgaag

SEQ ID NO: 1427 - DNA, 14 bp, synthetic construct
  source 1..14: mol_type = other DNA
ggagcgtgactatt

SEQ ID NO: 1428 - DNA, 14 bp, synthetic construct
  source 1..14: mol_type = other DNA
aggtatcggatctc

SEQ ID NO: 1429 - DNA, 14 bp, synthetic construct
  source 1..14: mol_type = other DNA
aaacctactaatta

SEQ ID NO: 1430 - DNA, 14 bp, synthetic construct
  source 1..14: mol_type = other DNA
gcaagctgatttgc

SEQ ID NO: 1431 - DNA, 14 bp, synthetic construct
  source 1..14: mol_type = other DNA
ataacgtgcgttcc

SEQ ID NO: 1432 - DNA, 14 bp, synthetic construct
  source 1..14: mol_type = other DNA
tctaatcaccgata

SEQ ID NO: 1433 - DNA, 14 bp, synthetic construct
  source 1..14: mol_type = other DNA
gttaagacctgatg

SEQ ID NO: 1434 - DNA, 14 bp, synthetic construct
  source 1..14: mol_type = other DNA
agtgtccaatagtg

SEQ ID NO: 1435 - DNA, 14 bp, synthetic construct
  source 1..14: mol_type = other DNA
ataagtgaaactat

SEQ ID NO: 1436 - DNA, 14 bp, synthetic construct
  source 1..14: mol_type = other DNA
atagcccctgtcgt

SEQ ID NO: 1437 - DNA, 14 bp, synthetic construct
  source 1..14: mol_type = other DNA
tgctgagcgtgtac

SEQ ID NO: 1438 - DNA, 14 bp, synthetic construct
  source 1..14: mol_type = other DNA
tacgctcgacctgt

SEQ ID NO: 1439 - DNA, 14 bp, synthetic construct
  source 1..14: mol_type = other DNA
gatcagtgtgtcaa

SEQ ID NO: 1440 - DNA, 14 bp, synthetic construct
  source 1..14: mol_type = other DNA
tcataatccagtgg

SEQ ID NO: 1441 - DNA, 14 bp, synthetic construct
  source 1..14: mol_type = other DNA
agataaaccatttc

SEQ ID NO: 1442 - DNA, 14 bp, synthetic construct
  source 1..14: mol_type = other DNA
tcgtctacccctgg

SEQ ID NO: 1443 - DNA, 14 bp, synthetic construct
  source 1..14: mol_type = other DNA
ggacgatggtggtt

SEQ ID NO: 1444 - DNA, 14 bp, synthetic construct
  source 1..14: mol_type = other DNA
gccctgtgacctgt

SEQ ID NO: 1445 - DNA, 14 bp, synthetic construct
  source 1..14: mol_type = other DNA
aagcgtaaattggt

SEQ ID NO: 1446 - DNA, 14 bp, synthetic construct
  source 1..14: mol_type = other DNA
aataggtggtagat

SEQ ID NO: 1447 - DNA, 14 bp, synthetic construct
  source 1..14: mol_type = other DNA
gtttacgatggaca

SEQ ID NO: 1448 - DNA, 14 bp, synthetic construct
  source 1..14: mol_type = other DNA
aacatataatggtg

SEQ ID NO: 1449 - DNA, 14 bp, synthetic construct
  source 1..14: mol_type = other DNA
agtaatggctagtc

SEQ ID NO: 1450 - DNA, 14 bp, synthetic construct
  source 1..14: mol_type = other DNA
gttgagcaagttcc

SEQ ID NO: 1451 - DNA, 14 bp, synthetic construct
  source 1..14: mol_type = other DNA
acaactactgctct

SEQ ID NO: 1452 - DNA, 14 bp, synthetic construct
  source 1..14: mol_type = other DNA
gtgatagagttgga

SEQ ID NO: 1453 - DNA, 14 bp, synthetic construct
  source 1..14: mol_type = other DNA
ctctatcagggtca

SEQ ID NO: 1454 - DNA, 14 bp, synthetic construct
  source 1..14: mol_type = other DNA
cacatcatgtgctg

SEQ ID NO: 1455 - DNA, 14 bp, synthetic construct
  source 1..14: mol_type = other DNA
agagtcgttgctcg

SEQ ID NO: 1456 - DNA, 14 bp, synthetic construct
  source 1..14: mol_type = other DNA
cccgagtctgtctc

SEQ ID NO: 1457 - DNA, 14 bp, synthetic construct
  source 1..14: mol_type = other DNA
catagagatgttgc

SEQ ID NO: 1458 - DNA, 14 bp, synthetic construct
  source 1..14: mol_type = other DNA
gagagtcatacctt

SEQ ID NO: 1459 - DNA, 14 bp, synthetic construct
  source 1..14: mol_type = other DNA
cggtcttcgggcct

SEQ ID NO: 1460 - DNA, 14 bp, synthetic construct
  source 1..14: mol_type = other DNA
ccgttcctggcgct

SEQ ID NO: 1461 - DNA, 14 bp, synthetic construct
  source 1..14: mol_type = other DNA
acgtttcgaccgat

SEQ ID NO: 1462 - DNA, 14 bp, synthetic construct
  source 1..14: mol_type = other DNA
gtgcttgatcacaa

SEQ ID NO: 1463 - DNA, 14 bp, synthetic construct
  source 1..14: mol_type = other DNA
tcaccaaagtactt

SEQ ID NO: 1464 - DNA, 14 bp, synthetic construct
  source 1..14: mol_type = other DNA
cgttaatatagcgg

SEQ ID NO: 1465 - DNA, 14 bp, synthetic construct
  source 1..14: mol_type = other DNA
tatgcagctaaatc

SEQ ID NO: 1466 - DNA, 14 bp, synthetic construct
  source 1..14: mol_type = other DNA
gtgcttgctcgacg

SEQ ID NO: 1467 - DNA, 14 bp, synthetic construct
  source 1..14: mol_type = other DNA
ccccgttgttgacg

SEQ ID NO: 1468 - DNA, 14 bp, synthetic construct
  source 1..14: mol_type = other DNA
cctgcgaaaatctt

SEQ ID NO: 1469 - DNA, 14 bp, synthetic construct
  source 1..14: mol_type = other DNA
tgtcacacgggtat

SEQ ID NO: 1470 - DNA, 14 bp, synthetic construct
  source 1..14: mol_type = other DNA
aaatctgctgtgcc

SEQ ID NO: 1471 - DNA, 14 bp, synthetic construct
  source 1..14: mol_type = other DNA
aggtctcttcgaag

SEQ ID NO: 1472 - DNA, 14 bp, synthetic construct
  source 1..14: mol_type = other DNA
cgaccgttcctagt

SEQ ID NO: 1473 - DNA, 14 bp, synthetic construct
  source 1..14: mol_type = other DNA
tccgcgtctcctca

SEQ ID NO: 1474 - DNA, 14 bp, synthetic construct
  source 1..14: mol_type = other DNA
agtagtagttacgg

SEQ ID NO: 1475 - DNA, 14 bp, synthetic construct
  source 1..14: mol_type = other DNA
gtgatgcaggctat

SEQ ID NO: 1476 - DNA, 14 bp, synthetic construct
  source 1..14: mol_type = other DNA
tcagctacaagttc

SEQ ID NO: 1477 - DNA, 14 bp, synthetic construct
  source 1..14: mol_type = other DNA
tccctcacctactc

SEQ ID NO: 1478 - DNA, 14 bp, synthetic construct
  source 1..14: mol_type = other DNA
actcttagtggcag

SEQ ID NO: 1479 - DNA, 14 bp, synthetic construct
  source 1..14: mol_type = other DNA
gaagtgatcttacc

SEQ ID NO: 1480 - DNA, 14 bp, synthetic construct
  source 1..14: mol_type = other DNA
acggttatatagca

SEQ ID NO: 1481 - DNA, 14 bp, synthetic construct
  source 1..14: mol_type = other DNA
gggtgattaactaa

SEQ ID NO: 1482 - DNA, 14 bp, synthetic construct
  source 1..14: mol_type = other DNA
ttaagatgtaggag

SEQ ID NO: 1483 - DNA, 14 bp, synthetic construct
  source 1..14: mol_type = other DNA
actaagctctcatc

SEQ ID NO: 1484 - DNA, 14 bp, synthetic construct
  source 1..14: mol_type = other DNA
ctggcttgaataaa

SEQ ID NO: 1485 - DNA, 14 bp, synthetic construct
  source 1..14: mol_type = other DNA
aaaccgcttgtgat

SEQ ID NO: 1486 - DNA, 14 bp, synthetic construct
  source 1..14: mol_type = other DNA
gtaacgtctaggtg

SEQ ID NO: 1487 - DNA, 14 bp, synthetic construct
  source 1..14: mol_type = other DNA
actgtcgagcctct

SEQ ID NO: 1488 - DNA, 14 bp, synthetic construct
  source 1..14: mol_type = other DNA
atttgggtgaagca

SEQ ID NO: 1489 - DNA, 14 bp, synthetic construct
  source 1..14: mol_type = other DNA
tcgtctcgcaaata

SEQ ID NO: 1490 - DNA, 14 bp, synthetic construct
  source 1..14: mol_type = other DNA
agctattataccgc

SEQ ID NO: 1491 - DNA, 14 bp, synthetic construct
  source 1..14: mol_type = other DNA
ctgggtagatagct

SEQ ID NO: 1492 - DNA, 14 bp, synthetic construct
  source 1..14: mol_type = other DNA
cctccacttatgcg

SEQ ID NO: 1493 - DNA, 14 bp, synthetic construct
  source 1..14: mol_type = other DNA
actcctagggtatg

SEQ ID NO: 1494 - DNA, 14 bp, synthetic construct
  source 1..14: mol_type = other DNA
cctttactgacggc

SEQ ID NO: 1495 - DNA, 14 bp, synthetic construct
  source 1..14: mol_type = other DNA
actgtcgcataatc

SEQ ID NO: 1496 - DNA, 14 bp, synthetic construct
  source 1..14: mol_type = other DNA
atctcagtctccag

SEQ ID NO: 1497 - DNA, 14 bp, synthetic construct
  source 1..14: mol_type = other DNA
cgctggcctgctct

SEQ ID NO: 1498 - DNA, 14 bp, synthetic construct
  source 1..14: mol_type = other DNA
aactttgggcctgg

SEQ ID NO: 1499 - DNA, 14 bp, synthetic construct
  source 1..14: mol_type = other DNA
ctcgtaatacatgg

SEQ ID NO: 1500 - DNA, 14 bp, synthetic construct
  source 1..14: mol_type = other DNA
aggactttgaatca

SEQ ID NO: 1501 - DNA, 14 bp, synthetic construct
  source 1..14: mol_type = other DNA
atgttagacgtgaa

SEQ ID NO: 1502 - DNA, 14 bp, synthetic construct
  source 1..14: mol_type = other DNA
aaagattttgcccc

SEQ ID NO: 1503 - DNA, 14 bp, synthetic construct
  source 1..14: mol_type = other DNA
aaagtacgtataat

SEQ ID NO: 1504 - DNA, 14 bp, synthetic construct
  source 1..14: mol_type = other DNA
tcgagttctaacca

SEQ ID NO: 1505 - DNA, 14 bp, synthetic construct
  source 1..14: mol_type = other DNA
atgttaggtacccc

SEQ ID NO: 1506 - DNA, 14 bp, synthetic construct
  source 1..14: mol_type = other DNA
actcgagcgtcctt

SEQ ID NO: 1507 - DNA, 14 bp, synthetic construct
  source 1..14: mol_type = other DNA
atgctactactggg

SEQ ID NO: 1508 - DNA, 14 bp, synthetic construct
  source 1..14: mol_type = other DNA
ttggtcgataagac

SEQ ID NO: 1509 - DNA, 14 bp, synthetic construct
  source 1..14: mol_type = other DNA
cagttgtgccctgg

SEQ ID NO: 1510 - DNA, 14 bp, synthetic construct
  source 1..14: mol_type = other DNA
agtacgatgtactg

SEQ ID NO: 1511 - DNA, 14 bp, synthetic construct
  source 1..14: mol_type = other DNA
gcttcgtgaaagct

SEQ ID NO: 1512 - DNA, 14 bp, synthetic construct
  source 1..14: mol_type = other DNA
tgccacgtcggttg

SEQ ID NO: 1513 - DNA, 14 bp, synthetic construct
  source 1..14: mol_type = other DNA
ctacttgcgagatc

SEQ ID NO: 1514 - DNA, 14 bp, synthetic construct
  source 1..14: mol_type = other DNA
taagatttgggagg

SEQ ID NO: 1515 - DNA, 14 bp, synthetic construct
  source 1..14: mol_type = other DNA
tacccaggttcgta

SEQ ID NO: 1516 - DNA, 14 bp, synthetic construct
  source 1..14: mol_type = other DNA
ttgggctccctcaa

SEQ ID NO: 1517 - DNA, 14 bp, synthetic construct
  source 1..14: mol_type = other DNA
ataactcacgttag

SEQ ID NO: 1518 - DNA, 14 bp, synthetic construct
  source 1..14: mol_type = other DNA
gcgttcagaccttg

SEQ ID NO: 1519 - DNA, 14 bp, synthetic construct
  source 1..14: mol_type = other DNA
cgattaaactcgat

SEQ ID NO: 1520 - DNA, 14 bp, synthetic construct
  source 1..14: mol_type = other DNA
ataattgacgtaca

SEQ ID NO: 1521 - DNA, 14 bp, synthetic construct
  source 1..14: mol_type = other DNA
ctgatttacggaac

SEQ ID NO: 1522 - DNA, 14 bp, synthetic construct
  source 1..14: mol_type = other DNA
gcactgttcgtacg

SEQ ID NO: 1523 - DNA, 14 bp, synthetic construct
  source 1..14: mol_type = other DNA
ctctcatgacagtg

SEQ ID NO: 1524 - DNA, 14 bp, synthetic construct
  source 1..14: mol_type = other DNA
tgcctggtgcactg

SEQ ID NO: 1525 - DNA, 14 bp, synthetic construct
  source 1..14: mol_type = other DNA
tccttacgtgggga

SEQ ID NO: 1526 - DNA, 14 bp, synthetic construct
  source 1..14: mol_type = other DNA
aaatgcgagtctta

SEQ ID NO: 1527 - DNA, 14 bp, synthetic construct
  source 1..14: mol_type = other DNA
gggttcgagtaatg

SEQ ID NO: 1528 - DNA, 14 bp, synthetic construct
  source 1..14: mol_type = other DNA
ctactactatcgag

SEQ ID NO: 1529 - DNA, 14 bp, synthetic construct
  source 1..14: mol_type = other DNA
aacaaaggatttgt

SEQ ID NO: 1530 - DNA, 14 bp, synthetic construct
  source 1..14: mol_type = other DNA
agtgtactacgcct

SEQ ID NO: 1531 - DNA, 14 bp, synthetic construct
  source 1..14: mol_type = other DNA
atctacccaactgt

SEQ ID NO: 1532 - DNA, 14 bp, synthetic construct
  source 1..14: mol_type = other DNA
tgggacgagcttgt

SEQ ID NO: 1533 - DNA, 14 bp, synthetic construct
  source 1..14: mol_type = other DNA
gttggatgatacca

SEQ ID NO: 1534 - DNA, 14 bp, synthetic construct
  source 1..14: mol_type = other DNA
agttgttaacggga

SEQ ID NO: 1535 - DNA, 14 bp, synthetic construct
  source 1..14: mol_type = other DNA
tcattagctgccga

SEQ ID NO: 1536 - DNA, 14 bp, synthetic construct
  source 1..14: mol_type = other DNA
gtttgtcaccaaag

SEQ ID NO: 1537 - DNA, 14 bp, synthetic construct
  source 1..14: mol_type = other DNA
ctgttggcccactc

SEQ ID NO: 1538 - DNA, 14 bp, synthetic construct
  source 1..14: mol_type = other DNA
taggtaagagatct

SEQ ID NO: 1539 - DNA, 14 bp, synthetic construct
  source 1..14: mol_type = other DNA
gcgtgagaccttat

SEQ ID NO: 1540 - DNA, 14 bp, synthetic construct
  source 1..14: mol_type = other DNA
caattaagcattcg

SEQ ID NO: 1541 - DNA, 14 bp, synthetic construct
  source 1..14: mol_type = other DNA
cgcacgttagttca

SEQ ID NO: 1542 - DNA, 14 bp, synthetic construct
  source 1..14: mol_type = other DNA
gagtcccacttctg

SEQ ID NO: 1543 - DNA, 14 bp, synthetic construct
  source 1..14: mol_type = other DNA
tacaattagcatgg

SEQ ID NO: 1544 - DNA, 14 bp, synthetic construct
  source 1..14: mol_type = other DNA
ctctctccctacag

SEQ ID NO: 1545 - DNA, 14 bp, synthetic construct
  source 1..14: mol_type = other DNA
tttagaccgctcac

SEQ ID NO: 1546 - DNA, 14 bp, synthetic construct
  source 1..14: mol_type = other DNA
cgacctaccattct

SEQ ID NO: 1547 - DNA, 14 bp, synthetic construct
  source 1..14: mol_type = other DNA
ttgaaaacgataat

SEQ ID NO: 1548 - DNA, 14 bp, synthetic construct
  source 1..14: mol_type = other DNA
tcgcgtacggcctt

SEQ ID NO: 1549 - DNA, 14 bp, synthetic construct
  source 1..14: mol_type = other DNA
gtaccggaaggttt

SEQ ID NO: 1550 - DNA, 14 bp, synthetic construct
  source 1..14: mol_type = other DNA
tcataaccgtggct

SEQ ID NO: 1551 - DNA, 14 bp, synthetic construct
  source 1..14: mol_type = other DNA
aatagtcgacatat

SEQ ID NO: 1552 - DNA, 14 bp, synthetic construct
  source 1..14: mol_type = other DNA
cgtatgccatgctc

SEQ ID NO: 1553 - DNA, 14 bp, synthetic construct
  source 1..14: mol_type = other DNA
gtttgcgcgactgc

SEQ ID NO: 1554 - DNA, 14 bp, synthetic construct
  source 1..14: mol_type = other DNA
aggaatttataccg

SEQ ID NO: 1555 - DNA, 14 bp, synthetic construct
  source 1..14: mol_type = other DNA
cttggccgtaatga

SEQ ID NO: 1556 - DNA, 14 bp, synthetic construct
  source 1..14: mol_type = other DNA
tcaacaatggggtt

SEQ ID NO: 1557 - DNA, 14 bp, synthetic construct
  source 1..14: mol_type = other DNA
caccgagtacattt

SEQ ID NO: 1558 - DNA, 14 bp, synthetic construct
  source 1..14: mol_type = other DNA
gcctgcacttataa

SEQ ID NO: 1559 - DNA, 14 bp, synthetic construct
  source 1..14: mol_type = other DNA
ggtgccaggtcctt

SEQ ID NO: 1560 - DNA, 14 bp, synthetic construct
  source 1..14: mol_type = other DNA
tcatcataggtaga

SEQ ID NO: 1561 - DNA, 14 bp, synthetic construct
  source 1..14: mol_type = other DNA
aggaccctttcgct

SEQ ID NO: 1562 - DNA, 14 bp, synthetic construct
  source 1..14: mol_type = other DNA
aggtacgactcttg

SEQ ID NO: 1563 - DNA, 14 bp, synthetic construct
  source 1..14: mol_type = other DNA
ctgatatagaacta

SEQ ID NO: 1564 - DNA, 14 bp, synthetic construct
  source 1..14: mol_type = other DNA
acttagggttagga

SEQ ID NO: 1565 - DNA, 14 bp, synthetic construct
  source 1..14: mol_type = other DNA
ggtcatggtcggtc

SEQ ID NO: 1566 - DNA, 14 bp, synthetic construct
  source 1..14: mol_type = other DNA
ctggtcgcttacgc

SEQ ID NO: 1567 - DNA, 14 bp, synthetic construct
  source 1..14: mol_type = other DNA
tcgggcttgtccag

SEQ ID NO: 1568 - DNA, 14 bp, synthetic construct
  source 1..14: mol_type = other DNA
caacggctttctcg

SEQ ID NO: 1569 - DNA, 14 bp, synthetic construct
  source 1..14: mol_type = other DNA
cgtcattcgaggtg

SEQ ID NO: 1570 - DNA, 14 bp, synthetic construct
  source 1..14: mol_type = other DNA
atctcaaaatagct

SEQ ID NO: 1571 - DNA, 14 bp, synthetic construct
  source 1..14: mol_type = other DNA
tacttacgaggtcg

SEQ ID NO: 1572 - DNA, 14 bp, synthetic construct
  source 1..14: mol_type = other DNA
agcacgaatttagt

SEQ ID NO: 1573 - DNA, 14 bp, synthetic construct
  source 1..14: mol_type = other DNA
ccgtgacttgaata

SEQ ID NO: 1574 - DNA, 14 bp, synthetic construct
  source 1..14: mol_type = other DNA
ggaatgatctgata

SEQ ID NO: 1575 - DNA, 14 bp, synthetic construct
  source 1..14: mol_type = other DNA
taatcaacggttac

SEQ ID NO: 1576 - DNA, 14 bp, synthetic construct
  source 1..14: mol_type = other DNA
agcttgtgctacga

SEQ ID NO: 1577 - DNA, 14 bp, synthetic construct
  source 1..14: mol_type = other DNA
tataaactgcggat

SEQ ID NO: 1578 - DNA, 14 bp, synthetic construct
  source 1..14: mol_type = other DNA
caggcccataattt

SEQ ID NO: 1579 - DNA, 14 bp, synthetic construct
  source 1..14: mol_type = other DNA
gcattggagtgctc

SEQ ID NO: 1580 - DNA, 14 bp, synthetic construct
  source 1..14: mol_type = other DNA
gactgctccttaca

SEQ ID NO: 1581 - DNA, 14 bp, synthetic construct
  source 1..14: mol_type = other DNA
gctgtgctgggatc

SEQ ID NO: 1582 - DNA, 14 bp, synthetic construct
  source 1..14: mol_type = other DNA
tcgtgaccgcttcg

SEQ ID NO: 1583 - DNA, 14 bp, synthetic construct
  source 1..14: mol_type = other DNA
acgcttcattaaag

SEQ ID NO: 1584 - DNA, 14 bp, synthetic construct
  source 1..14: mol_type = other DNA
aaaagctactattc

SEQ ID NO: 1585 - DNA, 14 bp, synthetic construct
  source 1..14: mol_type = other DNA
tacagcgcatttcg

SEQ ID NO: 1586 - DNA, 14 bp, synthetic construct
  source 1..14: mol_type = other DNA
taagttccataaag

SEQ ID NO: 1587 - DNA, 14 bp, synthetic construct
  source 1..14: mol_type = other DNA
aattttggacgccg

SEQ ID NO: 1588 - DNA, 14 bp, synthetic construct
  source 1..14: mol_type = other DNA
cctctctggatcga

SEQ ID NO: 1589 - DNA, 14 bp, synthetic construct
  source 1..14: mol_type = other DNA
cccttcatacccct

SEQ ID NO: 1590 - DNA, 14 bp, synthetic construct
  source 1..14: mol_type = other DNA
atgcttactgaccc

SEQ ID NO: 1591 - DNA, 14 bp, synthetic construct
  source 1..14: mol_type = other DNA
gagtctagttgcac

SEQ ID NO: 1592 - DNA, 14 bp, synthetic construct
  source 1..14: mol_type = other DNA
ggcactcttagcat

SEQ ID NO: 1593 - DNA, 14 bp, synthetic construct
  source 1..14: mol_type = other DNA
aatcattcccaagt

SEQ ID NO: 1594 - DNA, 14 bp, synthetic construct
  source 1..14: mol_type = other DNA
tgataggcaggttc

SEQ ID NO: 1595 - DNA, 14 bp, synthetic construct
  source 1..14: mol_type = other DNA
atcggcttgctggg

SEQ ID NO: 1596 - DNA, 14 bp, synthetic construct
  source 1..14: mol_type = other DNA
gtctaagtgaaatc

SEQ ID NO: 1597 - DNA, 14 bp, synthetic construct
  source 1..14: mol_type = other DNA
acggtgaaaatttg

SEQ ID NO: 1598 - DNA, 14 bp, synthetic construct
  source 1..14: mol_type = other DNA
atgccgcttctcaa

SEQ ID NO: 1599 - DNA, 14 bp, synthetic construct
  source 1..14: mol_type = other DNA
aattcgtcgagggt

SEQ ID NO: 1600 - DNA, 14 bp, synthetic construct
  source 1..14: mol_type = other DNA
ctctatcgggcatc

SEQ ID NO: 1601 - DNA, 14 bp, synthetic construct
  source 1..14: mol_type = other DNA
agtctcgcgagctt

SEQ ID NO: 1602 - DNA, 14 bp, synthetic construct
  source 1..14: mol_type = other DNA
cccgttggcagtat

SEQ ID NO: 1603 - DNA, 14 bp, synthetic construct
  source 1..14: mol_type = other DNA
gaactctccaattg

SEQ ID NO: 1604 - DNA, 14 bp, synthetic construct
  source 1..14: mol_type = other DNA
ggtgtcaattccgg

SEQ ID NO: 1605 - DNA, 14 bp, synthetic construct
  source 1..14: mol_type = other DNA
taatcagggttgaa

SEQ ID NO: 1606 - DNA, 14 bp, synthetic construct
  source 1..14: mol_type = other DNA
gtggcgtcgacatt

SEQ ID NO: 1607 - DNA, 14 bp, synthetic construct
  source 1..14: mol_type = other DNA
attgatctcaacgc

SEQ ID NO: 1608 - DNA, 14 bp, synthetic construct
  source 1..14: mol_type = other DNA
cgggagcatcgttt

SEQ ID NO: 1609 - DNA, 14 bp, synthetic construct
  source 1..14: mol_type = other DNA
atatccggctcctc

SEQ ID NO: 1610 - DNA, 14 bp, synthetic construct
  source 1..14: mol_type = other DNA
ctggaccctcactt

SEQ ID NO: 1611 - DNA, 14 bp, synthetic construct
  source 1..14: mol_type = other DNA
gggtagtcaatgtc

SEQ ID NO: 1612 - DNA, 14 bp, synthetic construct
  source 1..14: mol_type = other DNA
tccgttacccctaa

SEQ ID NO: 1613 - DNA, 14 bp, synthetic construct
  source 1..14: mol_type = other DNA
gctagctcctccta

SEQ ID NO: 1614 - DNA, 14 bp, synthetic construct
  source 1..14: mol_type = other DNA
ttaggtgaccgcta

SEQ ID NO: 1615 - DNA, 14 bp, synthetic construct
  source 1..14: mol_type = other DNA
tgcgtgcgactcgt

SEQ ID NO: 1616 - DNA, 14 bp, synthetic construct
  source 1..14: mol_type = other DNA
gagtccattatgcg

SEQ ID NO: 1617 - DNA, 14 bp, synthetic construct
  source 1..14: mol_type = other DNA
ctgacgccctctgt

SEQ ID NO: 1618 - DNA, 14 bp, synthetic construct
  source 1..14: mol_type = other DNA
cgtaatcagaatat

SEQ ID NO: 1619 - DNA, 14 bp, synthetic construct
  source 1..14: mol_type = other DNA
atctagactctaaa

SEQ ID NO: 1620 - DNA, 14 bp, synthetic construct
  source 1..14: mol_type = other DNA
tacgttaggatggg

SEQ ID NO: 1621 - DNA, 14 bp, synthetic construct
  source 1..14: mol_type = other DNA
cagtattaccatca

SEQ ID NO: 1622 - DNA, 14 bp, synthetic construct
  source 1..14: mol_type = other DNA
tcccttactccacg

SEQ ID NO: 1623 - DNA, 14 bp, synthetic construct
  source 1..14: mol_type = other DNA
ttcatacgactccc

SEQ ID NO: 1624 - DNA, 14 bp, synthetic construct
  source 1..14: mol_type = other DNA
cctggcgagttact

SEQ ID NO: 1625 - DNA, 14 bp, synthetic construct
  source 1..14: mol_type = other DNA
aatgaactggtctg

SEQ ID NO: 1626 - DNA, 14 bp, synthetic construct
  source 1..14: mol_type = other DNA
acttctccatacga

SEQ ID NO: 1627 - DNA, 14 bp, synthetic construct
  source 1..14: mol_type = other DNA
ctacatgattgccg

SEQ ID NO: 1628 - DNA, 14 bp, synthetic construct
  source 1..14: mol_type = other DNA
atggcttcggtaac

SEQ ID NO: 1629 - DNA, 14 bp, synthetic construct
  source 1..14: mol_type = other DNA
caccccttgtatca

SEQ ID NO: 1630 - DNA, 14 bp, synthetic construct
  source 1..14: mol_type = other DNA
tgcactaataaatg

SEQ ID NO: 1631 - DNA, 14 bp, synthetic construct
  source 1..14: mol_type = other DNA
gtctgtcgtacccg

SEQ ID NO: 1632 - DNA, 14 bp, synthetic construct
  source 1..14: mol_type = other DNA
actcgggttgtcct

SEQ ID NO: 1633 - DNA, 14 bp, synthetic construct
  source 1..14: mol_type = other DNA
ggccgtcagttatt

SEQ ID NO: 1634 - DNA, 14 bp, synthetic construct
  source 1..14: mol_type = other DNA
ggtcattattacgc

SEQ ID NO: 1635 - DNA, 14 bp, synthetic construct
  source 1..14: mol_type = other DNA
acgtcggtatgctt

SEQ ID NO: 1636 - DNA, 14 bp, synthetic construct
  source 1..14: mol_type = other DNA
gattgtacatagta

SEQ ID NO: 1637 - DNA, 14 bp, synthetic construct
  source 1..14: mol_type = other DNA
tgctgtcggaatgt

SEQ ID NO: 1638 - DNA, 14 bp, synthetic construct
  source 1..14: mol_type = other DNA
ccgggttctagttc

SEQ ID NO: 1639 - DNA, 14 bp, synthetic construct
  source 1..14: mol_type = other DNA
atacgatttcatac

SEQ ID NO: 1640 - DNA, 14 bp, synthetic construct
  source 1..14: mol_type = other DNA
tggctattcaagat

SEQ ID NO: 1641 - DNA, 14 bp, synthetic construct
  source 1..14: mol_type = other DNA
ggacgtgtgtattc

SEQ ID NO: 1642 - DNA, 14 bp, synthetic construct
  source 1..14: mol_type = other DNA
tatgcggtaagttc

SEQ ID NO: 1643 - DNA, 14 bp, synthetic construct
  source 1..14: mol_type = other DNA
cacggcgtgtcttt

SEQ ID NO: 1644 - DNA, 14 bp, synthetic construct
  source 1..14: mol_type = other DNA
atatattccaagta

SEQ ID NO: 1645 - DNA, 14 bp, synthetic construct
  source 1..14: mol_type = other DNA
ttcttaatccccgc

SEQ ID NO: 1646 - DNA, 14 bp, synthetic construct
  source 1..14: mol_type = other DNA
gcatggcttgttcg

SEQ ID NO: 1647 - DNA, 14 bp, synthetic construct
  source 1..14: mol_type = other DNA
aggcacactttttc

SEQ ID NO: 1648 - DNA, 14 bp, synthetic construct
  source 1..14: mol_type = other DNA
gctctaactgttgc

SEQ ID NO: 1649 - DNA, 14 bp, synthetic construct
  source 1..14: mol_type = other DNA
gataggcccttctt

SEQ ID NO: 1650 - DNA, 14 bp, synthetic construct
  source 1..14: mol_type = other DNA
tgatttggggatcg

SEQ ID NO: 1651 - DNA, 14 bp, synthetic construct
  source 1..14: mol_type = other DNA
gattcaatagatta

SEQ ID NO: 1652 - DNA, 14 bp, synthetic construct
  source 1..14: mol_type = other DNA
ttgcagcgactgtt

SEQ ID NO: 1653 - DNA, 14 bp, synthetic construct
  source 1..14: mol_type = other DNA
tatgctggatatcg

SEQ ID NO: 1654 - DNA, 14 bp, synthetic construct
  source 1..14: mol_type = other DNA
ctacataattagat

SEQ ID NO: 1655 - DNA, 14 bp, synthetic construct
  source 1..14: mol_type = other DNA
gctgtctcatagct

SEQ ID NO: 1656 - DNA, 14 bp, synthetic construct
  source 1..14: mol_type = other DNA
ccgacttacacttt

SEQ ID NO: 1657 - DNA, 14 bp, synthetic construct
  source 1..14: mol_type = other DNA
tcactgatcagtta

SEQ ID NO: 1658 - DNA, 14 bp, synthetic construct
  source 1..14: mol_type = other DNA
gtttgagcgttaca

SEQ ID NO: 1659 - DNA, 14 bp, synthetic construct
  source 1..14: mol_type = other DNA
aacctatgggttgt

SEQ ID NO: 1660 - DNA, 14 bp, synthetic construct
  source 1..14: mol_type = other DNA
agatggcattttaa

SEQ ID NO: 1661 - DNA, 14 bp, synthetic construct
  source 1..14: mol_type = other DNA
tatcatgcatacat

SEQ ID NO: 1662 - DNA, 14 bp, synthetic construct
  source 1..14: mol_type = other DNA
ttagatatacgtaa

SEQ ID NO: 1663 - DNA, 14 bp, synthetic construct
  source 1..14: mol_type = other DNA
tgcaaggctgtttg

SEQ ID NO: 1664 - DNA, 14 bp, synthetic construct
  source 1..14: mol_type = other DNA
agctggtgtttgcg

SEQ ID NO: 1665 - DNA, 14 bp, synthetic construct
  source 1..14: mol_type = other DNA
actctatatcaatg

SEQ ID NO: 1666 - DNA, 14 bp, synthetic construct
  source 1..14: mol_type = other DNA
aacttccctttccc

SEQ ID NO: 1667 - DNA, 14 bp, synthetic construct
  source 1..14: mol_type = other DNA
gcgcacctttctta

SEQ ID NO: 1668 - DNA, 14 bp, synthetic construct
  source 1..14: mol_type = other DNA
gttgacttgcctcg

SEQ ID NO: 1669 - DNA, 14 bp, synthetic construct
  source 1..14: mol_type = other DNA
tgacttgctaatga

SEQ ID NO: 1670 - DNA, 14 bp, synthetic construct
  source 1..14: mol_type = other DNA
gccattggattaat

SEQ ID NO: 1671 - DNA, 14 bp, synthetic construct
  source 1..14: mol_type = other DNA
tttaccctgtggag

SEQ ID NO: 1672 - DNA, 14 bp, synthetic construct
  source 1..14: mol_type = other DNA
tcatgtagtatacg

SEQ ID NO: 1673 - DNA, 14 bp, synthetic construct
  source 1..14: mol_type = other DNA
acatactcactatt

SEQ ID NO: 1674 - DNA, 14 bp, synthetic construct
  source 1..14: mol_type = other DNA
aatccgggttgtta

SEQ ID NO: 1675 - DNA, 14 bp, synthetic construct
  source 1..14: mol_type = other DNA
tgtaaatgcaaatt

SEQ ID NO: 1676 - DNA, 14 bp, synthetic construct
  source 1..14: mol_type = other DNA
tccgattacaattg

SEQ ID NO: 1677 - DNA, 14 bp, synthetic construct
  source 1..14: mol_type = other DNA
tggccgttttcgag

SEQ ID NO: 1678 - DNA, 14 bp, synthetic construct
  source 1..14: mol_type = other DNA
atcaacttctgggt

SEQ ID NO: 1679 - DNA, 14 bp, synthetic construct
  source 1..14: mol_type = other DNA
tcagcggttgtcat

SEQ ID NO: 1680 - DNA, 14 bp, synthetic construct
  source 1..14: mol_type = other DNA
tatttcatgcagac

SEQ ID NO: 1681 - DNA, 14 bp, synthetic construct
  source 1..14: mol_type = other DNA
gccttttcccgaat

SEQ ID NO: 1682 - DNA, 14 bp, synthetic construct
  source 1..14: mol_type = other DNA
tagttggctgatga

SEQ ID NO: 1683 - DNA, 14 bp, synthetic construct
  source 1..14: mol_type = other DNA
cggtacgttctcct

SEQ ID NO: 1684 - DNA, 14 bp, synthetic construct
  source 1..14: mol_type = other DNA
gggtttaacgatat

SEQ ID NO: 1685 - DNA, 14 bp, synthetic construct
  source 1..14: mol_type = other DNA
taaattacatggat

SEQ ID NO: 1686 - DNA, 14 bp, synthetic construct
  source 1..14: mol_type = other DNA
cgtttggatggcta

SEQ ID NO: 1687 - DNA, 14 bp, synthetic construct
  source 1..14: mol_type = other DNA
aggatgtattatgg

SEQ ID NO: 1688 - DNA, 14 bp, synthetic construct
  source 1..14: mol_type = other DNA
tgtatagcggagtt

SEQ ID NO: 1689 - DNA, 14 bp, synthetic construct
  source 1..14: mol_type = other DNA
atcattgtccgact

SEQ ID NO: 1690 - DNA, 14 bp, synthetic construct
  source 1..14: mol_type = other DNA
atctggtagttcag

SEQ ID NO: 1691 - DNA, 14 bp, synthetic construct
  source 1..14: mol_type = other DNA
ggatagtacgtttg

SEQ ID NO: 1692 - DNA, 14 bp, synthetic construct
  source 1..14: mol_type = other DNA
cttgctagctggta

SEQ ID NO: 1693 - DNA, 14 bp, synthetic construct
  source 1..14: mol_type = other DNA
ggatgtctttggca

SEQ ID NO: 1694 - DNA, 14 bp, synthetic construct
  source 1..14: mol_type = other DNA
gatataaaagtgtt

SEQ ID NO: 1695 - DNA, 14 bp, synthetic construct
  source 1..14: mol_type = other DNA
ttgagacgttctca

SEQ ID NO: 1696 - DNA, 14 bp, synthetic construct
  source 1..14: mol_type = other DNA
tagaagagtgttgt

SEQ ID NO: 1697 - DNA, 14 bp, synthetic construct
  source 1..14: mol_type = other DNA
ttgttaacgtggcg

SEQ ID NO: 1698 - DNA, 14 bp, synthetic construct
  source 1..14: mol_type = other DNA
ctgagtagtgtagt

SEQ ID NO: 1699 - DNA, 14 bp, synthetic construct
  source 1..14: mol_type = other DNA
tcccgatagttcta

SEQ ID NO: 1700 - DNA, 14 bp, synthetic construct
  source 1..14: mol_type = other DNA
attcgagtaagtgt

SEQ ID NO: 1701 - DNA, 14 bp, synthetic construct
  source 1..14: mol_type = other DNA
atttaccataagtg

SEQ ID NO: 1702 - DNA, 14 bp, synthetic construct
  source 1..14: mol_type = other DNA
ggctcagattctta

SEQ ID NO: 1703 - DNA, 14 bp, synthetic construct
  source 1..14: mol_type = other DNA
ggtactggttagat

SEQ ID NO: 1704 - DNA, 14 bp, synthetic construct
  source 1..14: mol_type = other DNA
acaggagttattct

SEQ ID NO: 1705 - DNA, 14 bp, synthetic construct
  source 1..14: mol_type = other DNA
agtatacgattact

SEQ ID NO: 1706 - DNA, 14 bp, synthetic construct
  source 1..14: mol_type = other DNA
tacttccaatcgtc

SEQ ID NO: 1707 - DNA, 14 bp, synthetic construct
  source 1..14: mol_type = other DNA
cttatactgtcaaa

SEQ ID NO: 1708 - DNA, 14 bp, synthetic construct
  source 1..14: mol_type = other DNA
gttaatgtcacctc

SEQ ID NO: 1709 - DNA, 14 bp, synthetic construct
  source 1..14: mol_type = other DNA
tttcggtcaatccc

SEQ ID NO: 1710 - DNA, 14 bp, synthetic construct
  source 1..14: mol_type = other DNA
gctccctttcgagt

SEQ ID NO: 1711 - DNA, 14 bp, synthetic construct
  source 1..14: mol_type = other DNA
tagtactccccatt

SEQ ID NO: 1712 - DNA, 14 bp, synthetic construct
  source 1..14: mol_type = other DNA
ctggttaacctagt

SEQ ID NO: 1713 - DNA, 14 bp, synthetic construct
  source 1..14: mol_type = other DNA
agccttgcgctttg

SEQ ID NO: 1714 - DNA, 14 bp, synthetic construct
  source 1..14: mol_type = other DNA
tccttagacattgg

SEQ ID NO: 1715 - DNA, 14 bp, synthetic construct
  source 1..14: mol_type = other DNA
ttgctgtccggtaa

SEQ ID NO: 1716 - DNA, 14 bp, synthetic construct
  source 1..14: mol_type = other DNA
ctatcagattatcg

SEQ ID NO: 1717 - DNA, 14 bp, synthetic construct
  source 1..14: mol_type = other DNA
tggatcccggttat

SEQ ID NO: 1718 - DNA, 14 bp, synthetic construct
  source 1..14: mol_type = other DNA
gtgtctacactatc

SEQ ID NO: 1719 - DNA, 14 bp, synthetic construct
  source 1..14: mol_type = other DNA
atttagatacctgg

SEQ ID NO: 1720 - DNA, 14 bp, synthetic construct
  source 1..14: mol_type = other DNA
taattcttcggagc

SEQ ID NO: 1721 - DNA, 14 bp, synthetic construct
  source 1..14: mol_type = other DNA
atttctcgcgaaat

SEQ ID NO: 1722 - DNA, 14 bp, synthetic construct
  source 1..14: mol_type = other DNA
tacagatggttcat

SEQ ID NO: 1723 - DNA, 14 bp, synthetic construct
  source 1..14: mol_type = other DNA
tgaaacagtttagt

SEQ ID NO: 1724 - DNA, 14 bp, synthetic construct
  source 1..14: mol_type = other DNA
ggcctttccatgat

SEQ ID NO: 1725 - DNA, 14 bp, synthetic construct
  source 1..14: mol_type = other DNA
tgtatacaggtcta

SEQ ID NO: 1726 - DNA, 14 bp, synthetic construct
  source 1..14: mol_type = other DNA
tcttctcgtccacg

SEQ ID NO: 1727 - DNA, 14 bp, synthetic construct
  source 1..14: mol_type = other DNA
atttttcacaaccg

SEQ ID NO: 1728 - DNA, 14 bp, synthetic construct
  source 1..14: mol_type = other DNA
gggtgatattgctc

SEQ ID NO: 1729 - DNA, 14 bp, synthetic construct
  source 1..14: mol_type = other DNA
ttgcgaggttgact

SEQ ID NO: 1730 - DNA, 14 bp, synthetic construct
  source 1..14: mol_type = other DNA
tgtagagttacagt

SEQ ID NO: 1731 - DNA, 14 bp, synthetic construct
  source 1..14: mol_type = other DNA
ctttgagagcatct

SEQ ID NO: 1732 - DNA, 14 bp, synthetic construct
  source 1..14: mol_type = other DNA
catatggtaatgtc

SEQ ID NO: 1733 - DNA, 14 bp, synthetic construct
  source 1..14: mol_type = other DNA
atcgtttggaagct

SEQ ID NO: 1734 - DNA, 14 bp, synthetic construct
  source 1..14: mol_type = other DNA
gggttatcattcga

SEQ ID NO: 1735 - DNA, 14 bp, synthetic construct
  source 1..14: mol_type = other DNA
tgctatgggtccat

SEQ ID NO: 1736 - DNA, 14 bp, synthetic construct
  source 1..14: mol_type = other DNA
tggggaaatcttat

SEQ ID NO: 1737 - DNA, 14 bp, synthetic construct
  source 1..14: mol_type = other DNA
gttcaataggtaat

SEQ ID NO: 1738 - DNA, 14 bp, synthetic construct
  source 1..14: mol_type = other DNA
ataaattctggact

SEQ ID NO: 1739 - DNA, 14 bp, synthetic construct
  source 1..14: mol_type = other DNA
gattctgccctcct

SEQ ID NO: 1740 - DNA, 14 bp, synthetic construct
  source 1..14: mol_type = other DNA
gtccaatctattaa

SEQ ID NO: 1741 - DNA, 14 bp, synthetic construct
  source 1..14: mol_type = other DNA
attcagtttaccgc

SEQ ID NO: 1742 - DNA, 14 bp, synthetic construct
  source 1..14: mol_type = other DNA
cgaaatctatgtta

SEQ ID NO: 1743 - DNA, 14 bp, synthetic construct
  source 1..14: mol_type = other DNA
tcgtctgggagtct

SEQ ID NO: 1744 - DNA, 14 bp, synthetic construct
  source 1..14: mol_type = other DNA
tcgaccttagcgtt

SEQ ID NO: 1745 - DNA, 14 bp, synthetic construct
  source 1..14: mol_type = other DNA
caaagtatgtttca

SEQ ID NO: 1746 - DNA, 14 bp, synthetic construct
  source 1..14: mol_type = other DNA
gttgaatccgtatg

SEQ ID NO: 1747 - DNA, 14 bp, synthetic construct
  source 1..14: mol_type = other DNA
ggcgtatatccttg

SEQ ID NO: 1748 - DNA, 14 bp, synthetic construct
  source 1..14: mol_type = other DNA
acctttgcctatca

SEQ ID NO: 1749 - DNA, 14 bp, synthetic construct
  source 1..14: mol_type = other DNA
ttaatacgcgtctg

SEQ ID NO: 1750 - DNA, 14 bp, synthetic construct
  source 1..14: mol_type = other DNA
taccgcctgtggtt

SEQ ID NO: 1751 - DNA, 14 bp, synthetic construct
  source 1..14: mol_type = other DNA
tgtcattgaatagg

SEQ ID NO: 1752 - DNA, 14 bp, synthetic construct
  source 1..14: mol_type = other DNA
tcgaacttgctact

SEQ ID NO: 1753 - DNA, 14 bp, synthetic construct
  source 1..14: mol_type = other DNA
agtatgcttatacg

SEQ ID NO: 1754 - DNA, 14 bp, synthetic construct
  source 1..14: mol_type = other DNA
taccatctcgtcta

SEQ ID NO: 1755 - DNA, 14 bp, synthetic construct
  source 1..14: mol_type = other DNA
acattgttagtgag

SEQ ID NO: 1756 - DNA, 14 bp, synthetic construct
  source 1..14: mol_type = other DNA
ctcgccgaattatt

SEQ ID NO: 1757 - DNA, 14 bp, synthetic construct
  source 1..14: mol_type = other DNA
ggtttacatgatcg

SEQ ID NO: 1758 - DNA, 14 bp, synthetic construct
  source 1..14: mol_type = other DNA
ttaaggagctcctt

SEQ ID NO: 1759 - DNA, 14 bp, synthetic construct
  source 1..14: mol_type = other DNA
taatgccgttgcct

SEQ ID NO: 1760 - DNA, 14 bp, synthetic construct
  source 1..14: mol_type = other DNA
aatctgatgagtct

SEQ ID NO: 1761 - DNA, 14 bp, synthetic construct
  source 1..14: mol_type = other DNA
cattttctaagaca

SEQ ID NO: 1762 - DNA, 14 bp, synthetic construct
  source 1..14: mol_type = other DNA
acctgcgcaatttt

SEQ ID NO: 1763 - DNA, 14 bp, synthetic construct
  source 1..14: mol_type = other DNA
cccgctagttttag

SEQ ID NO: 1764 - DNA, 14 bp, synthetic construct
  source 1..14: mol_type = other DNA
gtactgcacttatc

SEQ ID NO: 1765 - DNA, 14 bp, synthetic construct
  source 1..14: mol_type = other DNA
tccgagttcttgcg

SEQ ID NO: 1766 - DNA, 14 bp, synthetic construct
  source 1..14: mol_type = other DNA
tgcgtagtacgttc

SEQ ID NO: 1767 - DNA, 14 bp, synthetic construct
  source 1..14: mol_type = other DNA
cattgtcggatatg

SEQ ID NO: 1768 - DNA, 14 bp, synthetic construct
  source 1..14: mol_type = other DNA
ggcttcctgaattc

SEQ ID NO: 1769 - DNA, 14 bp, synthetic construct
  source 1..14: mol_type = other DNA
acacgtttgtcact

SEQ ID NO: 1770 - DNA, 14 bp, synthetic construct
  source 1..14: mol_type = other DNA
gtgctactccgtct

SEQ ID NO: 1771 - DNA, 14 bp, synthetic construct
  source 1..14: mol_type = other DNA
aaattttggggata

SEQ ID NO: 1772 - DNA, 14 bp, synthetic construct
  source 1..14: mol_type = other DNA
tatactaaggatat

SEQ ID NO: 1773 - DNA, 14 bp, synthetic construct
  source 1..14: mol_type = other DNA
atccgtgtatgata

SEQ ID NO: 1774 - DNA, 14 bp, synthetic construct
  source 1..14: mol_type = other DNA
ctcaaattatcact

SEQ ID NO: 1775 - DNA, 14 bp, synthetic construct
  source 1..14: mol_type = other DNA
aatgttgcatctga

SEQ ID NO: 1776 - DNA, 14 bp, synthetic construct
  source 1..14: mol_type = other DNA
agaaagttttacta

SEQ ID NO: 1777 - DNA, 14 bp, synthetic construct
  source 1..14: mol_type = other DNA
gcttttgaaggaat

SEQ ID NO: 1778 - DNA, 14 bp, synthetic construct
  source 1..14: mol_type = other DNA
gctttcagctacta

SEQ ID NO: 1779 - DNA, 14 bp, synthetic construct
  source 1..14: mol_type = other DNA
gctttactctacac

SEQ ID NO: 1780 - DNA, 14 bp, synthetic construct
  source 1..14: mol_type = other DNA
ttaagctacatagt

SEQ ID NO: 1781 - DNA, 14 bp, synthetic construct
  source 1..14: mol_type = other DNA
gatttggcggtgct

SEQ ID NO: 1782 - DNA, 14 bp, synthetic construct
  source 1..14: mol_type = other DNA
aagttgcctggatt

SEQ ID NO: 1783 - DNA, 14 bp, synthetic construct
  source 1..14: mol_type = other DNA
cacattatttgaca

SEQ ID NO: 1784 - DNA, 14 bp, synthetic construct
  source 1..14: mol_type = other DNA
tgtacccgtctata

SEQ ID NO: 1785 - DNA, 14 bp, synthetic construct
  source 1..14: mol_type = other DNA
ttgtcacgtaacat

SEQ ID NO: 1786 - DNA, 14 bp, synthetic construct
  source 1..14: mol_type = other DNA
gagatgaattgttc

SEQ ID NO: 1787 - DNA, 14 bp, synthetic construct
  source 1..14: mol_type = other DNA
gattccttgtaaaa

SEQ ID NO: 1788 - DNA, 14 bp, synthetic construct
  source 1..14: mol_type = other DNA
tcagactgttgatc

SEQ ID NO: 1789 - DNA, 14 bp, synthetic construct
  source 1..14: mol_type = other DNA
gcgttcatttagac

SEQ ID NO: 1790 - DNA, 14 bp, synthetic construct
  source 1..14: mol_type = other DNA
atattcatcgcata

SEQ ID NO: 1791 - DNA, 14 bp, synthetic construct
  source 1..14: mol_type = other DNA
ctctgactttacga

SEQ ID NO: 1792 - DNA, 14 bp, synthetic construct
  source 1..14: mol_type = other DNA
gctagtatgacctt

SEQ ID NO: 1793 - DNA, 14 bp, synthetic construct
  source 1..14: mol_type = other DNA
tagtgcacttactc

SEQ ID NO: 1794 - DNA, 14 bp, synthetic construct
  source 1..14: mol_type = other DNA
ctttaccatctgcc

SEQ ID NO: 1795 - DNA, 14 bp, synthetic construct
  source 1..14: mol_type = other DNA
tgtcgctaatgaat

SEQ ID NO: 1796 - DNA, 14 bp, synthetic construct
  source 1..14: mol_type = other DNA
gagctgagttttga

SEQ ID NO: 1797 - DNA, 14 bp, synthetic construct
  source 1..14: mol_type = other DNA
ttagcattcatagg

SEQ ID NO: 1798 - DNA, 14 bp, synthetic construct
  source 1..14: mol_type = other DNA
aatggtcctttacg

SEQ ID NO: 1799 - DNA, 14 bp, synthetic construct
  source 1..14: mol_type = other DNA
tatgtaatgaactc

SEQ ID NO: 1800 - DNA, 14 bp, synthetic construct
  source 1..14: mol_type = other DNA
gtgggtagtcattg

SEQ ID NO: 1801 - DNA, 14 bp, synthetic construct
  source 1..14: mol_type = other DNA
cgtatgtcgtccgt

SEQ ID NO: 1802 - DNA, 14 bp, synthetic construct
  source 1..14: mol_type = other DNA
gtactggtgtgcat

SEQ ID NO: 1803 - DNA, 14 bp, synthetic construct
  source 1..14: mol_type = other DNA
tgacccttgtagtg

SEQ ID NO: 1804 - DNA, 14 bp, synthetic construct
  source 1..14: mol_type = other DNA
gattctcacgttgg

SEQ ID NO: 1805 - DNA, 14 bp, synthetic construct
  source 1..14: mol_type = other DNA
agctttgttagcaa

SEQ ID NO: 1806 - DNA, 14 bp, synthetic construct
  source 1..14: mol_type = other DNA
gcctactatatatg

SEQ ID NO: 1807 - DNA, 14 bp, synthetic construct
  source 1..14: mol_type = other DNA
aattttggcatcga

SEQ ID NO: 1808 - DNA, 14 bp, synthetic construct
  source 1..14: mol_type = other DNA
acattggttactac

SEQ ID NO: 1809 - DNA, 14 bp, synthetic construct
  source 1..14: mol_type = other DNA
aacaatgctgttct

SEQ ID NO: 1810 - DNA, 14 bp, synthetic construct
  source 1..14: mol_type = other DNA
tgggttagaatgta

SEQ ID NO: 1811 - DNA, 14 bp, synthetic construct
  source 1..14: mol_type = other DNA
tgcccgatgttatc

SEQ ID NO: 1812 - DNA, 14 bp, synthetic construct
  source 1..14: mol_type = other DNA
attcatagggttac

SEQ ID NO: 1813 - DNA, 14 bp, synthetic construct
  source 1..14: mol_type = other DNA
cttcatcttgacga

SEQ ID NO: 1814 - DNA, 14 bp, synthetic construct
  source 1..14: mol_type = other DNA
actatatggaggtt

SEQ ID NO: 1815 - DNA, 14 bp, synthetic construct
  source 1..14: mol_type = other DNA
ataggtaatgttca

SEQ ID NO: 1816 - DNA, 14 bp, synthetic construct
  source 1..14: mol_type = other DNA
ctacgtgggtatgt

SEQ ID NO: 1817 - DNA, 14 bp, synthetic construct
  source 1..14: mol_type = other DNA
cttcggtcactata

SEQ ID NO: 1818 - DNA, 14 bp, synthetic construct
  source 1..14: mol_type = other DNA
tgtagccctttaag

SEQ ID NO: 1819 - DNA, 14 bp, synthetic construct
  source 1..14: mol_type = other DNA
gaatttgcgcgttc

SEQ ID NO: 1820 - DNA, 14 bp, synthetic construct
  source 1..14: mol_type = other DNA
aggtgtttagcaat

SEQ ID NO: 1821 - DNA, 14 bp, synthetic construct
  source 1..14: mol_type = other DNA
cgttgctgattcac

SEQ ID NO: 1822 - DNA, 14 bp, synthetic construct
  source 1..14: mol_type = other DNA
catctttatgcgcg

SEQ ID NO: 1823 - DNA, 14 bp, synthetic construct
  source 1..14: mol_type = other DNA
taaattggtgtgcg

SEQ ID NO: 1824 - DNA, 14 bp, synthetic construct
  source 1..14: mol_type = other DNA
ctcctgaactattc

SEQ ID NO: 1825 - DNA, 14 bp, synthetic construct
  source 1..14: mol_type = other DNA
aatcgactctcttc

SEQ ID NO: 1826 - DNA, 14 bp, synthetic construct
  source 1..14: mol_type = other DNA
ttcaatttgcaacc

SEQ ID NO: 1827 - DNA, 14 bp, synthetic construct
  source 1..14: mol_type = other DNA
atattagctctgcg

SEQ ID NO: 1828 - DNA, 14 bp, synthetic construct
  source 1..14: mol_type = other DNA
gacttaaggttcta

SEQ ID NO: 1829 - DNA, 14 bp, synthetic construct
  source 1..14: mol_type = other DNA
cctctttacataaa

SEQ ID NO: 1830 - DNA, 14 bp, synthetic construct
  source 1..14: mol_type = other DNA
gtaacacatttatg

SEQ ID NO: 1831 - DNA, 14 bp, synthetic construct
  source 1..14: mol_type = other DNA
tgattaatgatccg

SEQ ID NO: 1832 - DNA, 14 bp, synthetic construct
  source 1..14: mol_type = other DNA
ctctactggtggtg

SEQ ID NO: 1833 - DNA, 14 bp, synthetic construct
  source 1..14: mol_type = other DNA
attttgtgcgggcg

SEQ ID NO: 1834 - DNA, 14 bp, synthetic construct
  source 1..14: mol_type = other DNA
ccggagatttcgtt

SEQ ID NO: 1835 - DNA, 14 bp, synthetic construct
  source 1..14: mol_type = other DNA
ctcttttgacaagc

SEQ ID NO: 1836 - DNA, 14 bp, synthetic construct
  source 1..14: mol_type = other DNA
taattggatgacat

SEQ ID NO: 1837 - DNA, 14 bp, synthetic construct
  source 1..14: mol_type = other DNA
agtttccacgttca

SEQ ID NO: 1838 - DNA, 14 bp, synthetic construct
  source 1..14: mol_type = other DNA
cgtgttgtgtcaga

SEQ ID NO: 1839 - DNA, 14 bp, synthetic construct
  source 1..14: mol_type = other DNA
agtagttttgggaa

SEQ ID NO: 1840 - DNA, 14 bp, synthetic construct
  source 1..14: mol_type = other DNA
ttatgagggtcgtg

SEQ ID NO: 1841 - DNA, 14 bp, synthetic construct
  source 1..14: mol_type = other DNA
tgcgagatctttgc

SEQ ID NO: 1842 - DNA, 14 bp, synthetic construct
  source 1..14: mol_type = other DNA
taacctttcgatcg

SEQ ID NO: 1843 - DNA, 14 bp, synthetic construct
  source 1..14: mol_type = other DNA
actctgagattata

SEQ ID NO: 1844 - DNA, 14 bp, synthetic construct
  source 1..14: mol_type = other DNA
ttcgcctccggctt

SEQ ID NO: 1845 - DNA, 14 bp, synthetic construct
  source 1..14: mol_type = other DNA
ccggtgttacattc

SEQ ID NO: 1846 - DNA, 14 bp, synthetic construct
  source 1..14: mol_type = other DNA
tcggatcattcgat

SEQ ID NO: 1847 - DNA, 14 bp, synthetic construct
  source 1..14: mol_type = other DNA
gattcatctatggc

SEQ ID NO: 1848 - DNA, 14 bp, synthetic construct
  source 1..14: mol_type = other DNA
atttcctcgccata

SEQ ID NO: 1849 - DNA, 14 bp, synthetic construct
  source 1..14: mol_type = other DNA
acgtctacgttaat

SEQ ID NO: 1850 - DNA, 14 bp, synthetic construct
  source 1..14: mol_type = other DNA
agtaaggttatctc

SEQ ID NO: 1851 - DNA, 14 bp, synthetic construct
  source 1..14: mol_type = other DNA
ccttctataatgcc

SEQ ID NO: 1852 - DNA, 14 bp, synthetic construct
  source 1..14: mol_type = other DNA
gctcccgaatcttt

SEQ ID NO: 1853 - DNA, 14 bp, synthetic construct
  source 1..14: mol_type = other DNA
ttgtttccaaaacc

SEQ ID NO: 1854 - DNA, 14 bp, synthetic construct
  source 1..14: mol_type = other DNA
ttgaattgcacggt

SEQ ID NO: 1855 - DNA, 14 bp, synthetic construct
  source 1..14: mol_type = other DNA
gtcttggttcagag

SEQ ID NO: 1856 - DNA, 14 bp, synthetic construct
  source 1..14: mol_type = other DNA
taacgtggcttgtc

SEQ ID NO: 1857 - DNA, 14 bp, synthetic construct
  source 1..14: mol_type = other DNA
tccttgtctgcgcc

SEQ ID NO: 1858 - DNA, 14 bp, synthetic construct
  source 1..14: mol_type = other DNA
attgctgtatggga

SEQ ID NO: 1859 - DNA, 14 bp, synthetic construct
  source 1..14: mol_type = other DNA
ttggattcaactaa

SEQ ID NO: 1860 - DNA, 14 bp, synthetic construct
  source 1..14: mol_type = other DNA
cctttcatactggg

SEQ ID NO: 1861 - DNA, 14 bp, synthetic construct
  source 1..14: mol_type = other DNA
cgaggctctatgtt

SEQ ID NO: 1862 - DNA, 14 bp, synthetic construct
  source 1..14: mol_type = other DNA
gtctactttgaacg

SEQ ID NO: 1863 - DNA, 14 bp, synthetic construct
  source 1..14: mol_type = other DNA
gcaaatatgtgttc

SEQ ID NO: 1864 - DNA, 14 bp, synthetic construct
  source 1..14: mol_type = other DNA
gagtctaatttaga

SEQ ID NO: 1865 - DNA, 14 bp, synthetic construct
  source 1..14: mol_type = other DNA
tcggtttgacataa

SEQ ID NO: 1866 - DNA, 14 bp, synthetic construct
  source 1..14: mol_type = other DNA
cgtcttgctggtag

SEQ ID NO: 1867 - DNA, 14 bp, synthetic construct
  source 1..14: mol_type = other DNA
ttgattatagcccg

SEQ ID NO: 1868 - DNA, 14 bp, synthetic construct
  source 1..14: mol_type = other DNA
taatctcacgattc

SEQ ID NO: 1869 - DNA, 14 bp, synthetic construct
  source 1..14: mol_type = other DNA
ctctgtccgtgtgg

SEQ ID NO: 1870 - DNA, 14 bp, synthetic construct
  source 1..14: mol_type = other DNA
actccattcgattc

SEQ ID NO: 1871 - DNA, 14 bp, synthetic construct
  source 1..14: mol_type = other DNA
ttgcacgtgattga

SEQ ID NO: 1872 - DNA, 14 bp, synthetic construct
  source 1..14: mol_type = other DNA
cttcactatcgaat

SEQ ID NO: 1873 - DNA, 14 bp, synthetic construct
  source 1..14: mol_type = other DNA
ggctacatagttct

SEQ ID NO: 1874 - DNA, 14 bp, synthetic construct
  source 1..14: mol_type = other DNA
ggttttgtggcacc

SEQ ID NO: 1875 - DNA, 14 bp, synthetic construct
  source 1..14: mol_type = other DNA
ttgtgtataagagc

SEQ ID NO: 1876 - DNA, 14 bp, synthetic construct
  source 1..14: mol_type = other DNA
cgtgctagattgat

SEQ ID NO: 1877 - DNA, 14 bp, synthetic construct
  source 1..14: mol_type = other DNA
ctcgattcctgtcg

SEQ ID NO: 1878 - DNA, 14 bp, synthetic construct
  source 1..14: mol_type = other DNA
ttatcaaccgtcct

SEQ ID NO: 1879 - DNA, 14 bp, synthetic construct
  source 1..14: mol_type = other DNA
ctcctgtgctagat

SEQ ID NO: 1880 - DNA, 14 bp, synthetic construct
  source 1..14: mol_type = other DNA
cttgcgtattaaaa

SEQ ID NO: 1881 - DNA, 14 bp, synthetic construct
  source 1..14: mol_type = other DNA
ctgtcacttgtaag

SEQ ID NO: 1882 - DNA, 14 bp, synthetic construct
  source 1..14: mol_type = other DNA
catgcgtatgatgt

SEQ ID NO: 1883 - DNA, 14 bp, synthetic construct
  source 1..14: mol_type = other DNA
ttcagcgcttctga

SEQ ID NO: 1884 - DNA, 14 bp, synthetic construct
  source 1..14: mol_type = other DNA
tttcaccgggtata

SEQ ID NO: 1885 - DNA, 14 bp, synthetic construct
  source 1..14: mol_type = other DNA
tcaacctggtttcg

SEQ ID NO: 1886 - DNA, 14 bp, synthetic construct
  source 1..14: mol_type = other DNA
tggggctcctaatt

SEQ ID NO: 1887 - DNA, 14 bp, synthetic construct
  source 1..14: mol_type = other DNA
atctatgtgagaat

SEQ ID NO: 1888 - DNA, 14 bp, synthetic construct
  source 1..14: mol_type = other DNA
gatgtttctcgcgc

SEQ ID NO: 1889 - DNA, 14 bp, synthetic construct
  source 1..14: mol_type = other DNA
acacctttgtgtgc

SEQ ID NO: 1890 - DNA, 14 bp, synthetic construct
  source 1..14: mol_type = other DNA
gctggctttgtgtg

SEQ ID NO: 1891 - DNA, 14 bp, synthetic construct
  source 1..14: mol_type = other DNA
ttaatcttaggtac

SEQ ID NO: 1892 - DNA, 14 bp, synthetic construct
  source 1..14: mol_type = other DNA
ttgaagtctttagg

SEQ ID NO: 1893 - DNA, 14 bp, synthetic construct
  source 1..14: mol_type = other DNA
gtgatcggaatttt

SEQ ID NO: 1894 - DNA, 14 bp, synthetic construct
  source 1..14: mol_type = other DNA
tagcatgttttgca

SEQ ID NO: 1895 - DNA, 14 bp, synthetic construct
  source 1..14: mol_type = other DNA
tttctgtgggccgt

SEQ ID NO: 1896 - DNA, 14 bp, synthetic construct
  source 1..14: mol_type = other DNA
tcccgctctgtgtt

SEQ ID NO: 1897 - DNA, 14 bp, synthetic construct
  source 1..14: mol_type = other DNA
agcctttcgtatat

SEQ ID NO: 1898 - DNA, 14 bp, synthetic construct
  source 1..14: mol_type = other DNA
acaattccttgctt

SEQ ID NO: 1899 - DNA, 14 bp, synthetic construct
  source 1..14: mol_type = other DNA
tgtggcatttgtgg

SEQ ID NO: 1900 - DNA, 14 bp, synthetic construct
  source 1..14: mol_type = other DNA
taatgttctgatgc

SEQ ID NO: 1901 - DNA, 14 bp, synthetic construct
  source 1..14: mol_type = other DNA
tccgtccttgtaat

SEQ ID NO: 1902 - DNA, 14 bp, synthetic construct
  source 1..14: mol_type = other DNA
catttgtgagttgc

SEQ ID NO: 1903 - DNA, 14 bp, synthetic construct
  source 1..14: mol_type = other DNA
tatgtgtccgtctc

SEQ ID NO: 1904 - DNA, 14 bp, synthetic construct
  source 1..14: mol_type = other DNA
agtgacatggtttt

SEQ ID NO: 1905 - DNA, 14 bp, synthetic construct
  source 1..14: mol_type = other DNA
ctgggtctcttgta

SEQ ID NO: 1906 - DNA, 14 bp, synthetic construct
  source 1..14: mol_type = other DNA
ttgtagaatgattc

SEQ ID NO: 1907 - DNA, 14 bp, synthetic construct
  source 1..14: mol_type = other DNA
tattatatggacta

SEQ ID NO: 1908 - DNA, 14 bp, synthetic construct
  source 1..14: mol_type = other DNA
cggtggtatctatt

SEQ ID NO: 1909 - DNA, 14 bp, synthetic construct
  source 1..14: mol_type = other DNA
ctttttgactaacc

SEQ ID NO: 1910 - DNA, 14 bp, synthetic construct
  source 1..14: mol_type = other DNA
attacgctggtgtt

SEQ ID NO: 1911 - DNA, 14 bp, synthetic construct
  source 1..14: mol_type = other DNA
tatttctaagagtg

SEQ ID NO: 1912 - DNA, 14 bp, synthetic construct
  source 1..14: mol_type = other DNA
ttagtcctgtcact

SEQ ID NO: 1913 - DNA, 14 bp, synthetic construct
  source 1..14: mol_type = other DNA
actgatttaagtat

SEQ ID NO: 1914 - DNA, 14 bp, synthetic construct
  source 1..14: mol_type = other DNA
cagcttttggctta

SEQ ID NO: 1915 - DNA, 14 bp, synthetic construct
  source 1..14: mol_type = other DNA
ggcgttctttcact

SEQ ID NO: 1916 - DNA, 14 bp, synthetic construct
  source 1..14: mol_type = other DNA
ggtatgttcgtgtc

SEQ ID NO: 1917 - DNA, 14 bp, synthetic construct
  source 1..14: mol_type = other DNA
attctgttacgtaa

SEQ ID NO: 1918 - DNA, 14 bp, synthetic construct
  source 1..14: mol_type = other DNA
catgatcaatttct

SEQ ID NO: 1919 - DNA, 14 bp, synthetic construct
  source 1..14: mol_type = other DNA
ctatgttagttaac

SEQ ID NO: 1920 - DNA, 14 bp, synthetic construct
  source 1..14: mol_type = other DNA
tccttgtcgtagat

SEQ ID NO: 1921 - DNA, 14 bp, synthetic construct
  source 1..14: mol_type = other DNA
attgtcgtgatagt

SEQ ID NO: 1922 - DNA, 14 bp, synthetic construct
  source 1..14: mol_type = other DNA
tgatattagcactt

SEQ ID NO: 1923 - DNA, 14 bp, synthetic construct
  source 1..14: mol_type = other DNA
tcgtggattgatat

SEQ ID NO: 1924 - DNA, 14 bp, synthetic construct
  source 1..14: mol_type = other DNA
tacttgttgatacg

SEQ ID NO: 1925 - DNA, 14 bp, synthetic construct
  source 1..14: mol_type = other DNA
ttgattgtggataa

SEQ ID NO: 1926 - DNA, 14 bp, synthetic construct
  source 1..14: mol_type = other DNA
agggtgtatttaat

SEQ ID NO: 1927 - DNA, 14 bp, synthetic construct
  source 1..14: mol_type = other DNA
cgtcgtgttactat

SEQ ID NO: 1928 - DNA, 14 bp, synthetic construct
  source 1..14: mol_type = other DNA
taatatcttagcgt

SEQ ID NO: 1929 - DNA, 14 bp, synthetic construct
  source 1..14: mol_type = other DNA
ggagatcttttggt

SEQ ID NO: 1930 - DNA, 14 bp, synthetic construct
  source 1..14: mol_type = other DNA
atatccttcatgct

SEQ ID NO: 1931 - DNA, 14 bp, synthetic construct
  source 1..14: mol_type = other DNA
cttagatcttagtg

SEQ ID NO: 1932 - DNA, 14 bp, synthetic construct
  source 1..14: mol_type = other DNA
ttattgtaccactg

SEQ ID NO: 1933 - DNA, 14 bp, synthetic construct
  source 1..14: mol_type = other DNA
gcagtgccttcttt

SEQ ID NO: 1934 - DNA, 14 bp, synthetic construct
  source 1..14: mol_type = other DNA
attatcatgtctac

SEQ ID NO: 1935 - DNA, 14 bp, synthetic construct
  source 1..14: mol_type = other DNA
cacctgtatttcat

SEQ ID NO: 1936 - DNA, 14 bp, synthetic construct
  source 1..14: mol_type = other DNA
ctatgttgaagttc

SEQ ID NO: 1937 - DNA, 14 bp, synthetic construct
  source 1..14: mol_type = other DNA
ctgctgtgcttata

SEQ ID NO: 1938 - DNA, 14 bp, synthetic construct
  source 1..14: mol_type = other DNA
tttctgacaccttg

SEQ ID NO: 1939 - DNA, 14 bp, synthetic construct
  source 1..14: mol_type = other DNA
tagcggcatttttg

SEQ ID NO: 1940 - DNA, 14 bp, synthetic construct
  source 1..14: mol_type = other DNA
catcggtcttcttc

SEQ ID NO: 1941 - DNA, 14 bp, synthetic construct
  source 1..14: mol_type = other DNA
gttactaatgtgtg

SEQ ID NO: 1942 - DNA, 14 bp, synthetic construct
  source 1..14: mol_type = other DNA
gattgatctagtct

SEQ ID NO: 1943 - DNA, 14 bp, synthetic construct
  source 1..14: mol_type = other DNA
gtagttatgattcg

SEQ ID NO: 1944 - DNA, 14 bp, synthetic construct
  source 1..14: mol_type = other DNA
ttttcaagtggata

SEQ ID NO: 1945 - DNA, 14 bp, synthetic construct
  source 1..14: mol_type = other DNA
tctatttcatcagc

SEQ ID NO: 1946 - DNA, 14 bp, synthetic construct
  source 1..14: mol_type = other DNA
gggcttcgttctgt

SEQ ID NO: 1947 - DNA, 14 bp, synthetic construct
  source 1..14: mol_type = other DNA
tttgtccttaccgc

SEQ ID NO: 1948 - DNA, 14 bp, synthetic construct
  source 1..14: mol_type = other DNA
catgtctctttagc

SEQ ID NO: 1949 - DNA, 14 bp, synthetic construct
  source 1..14: mol_type = other DNA
tgtgtagtgcctgt

SEQ ID NO: 1950 - DNA, 14 bp, synthetic construct
  source 1..14: mol_type = other DNA
tacatatatgtggt

SEQ ID NO: 1951 - DNA, 14 bp, synthetic construct
  source 1..14: mol_type = other DNA
ggttctgtctgggt

SEQ ID NO: 1952 - DNA, 14 bp, synthetic construct
  source 1..14: mol_type = other DNA
ggagcttattgtta

SEQ ID NO: 1953 - DNA, 14 bp, synthetic construct
  source 1..14: mol_type = other DNA
tgtgcttatagact

SEQ ID NO: 1954 - DNA, 14 bp, synthetic construct
  source 1..14: mol_type = other DNA
gctattcttggtga

SEQ ID NO: 1955 - DNA, 14 bp, synthetic construct
  source 1..14: mol_type = other DNA
gattatcgtgcctt

SEQ ID NO: 1956 - DNA, 14 bp, synthetic construct
  source 1..14: mol_type = other DNA
attactttctagcg

SEQ ID NO: 1957 - DNA, 14 bp, synthetic construct
  source 1..14: mol_type = other DNA
atttcgtggagttg

SEQ ID NO: 1958 - DNA, 14 bp, synthetic construct
  source 1..14: mol_type = other DNA
ttcttgggcctact

SEQ ID NO: 1959 - DNA, 14 bp, synthetic construct
  source 1..14: mol_type = other DNA
ctttgatcttcagc

SEQ ID NO: 1960 - DNA, 14 bp, synthetic construct
  source 1..14: mol_type = other DNA
agcgattcttagtt

SEQ ID NO: 1961 - DNA, 14 bp, synthetic construct
  source 1..14: mol_type = other DNA
cattctcattgtga

SEQ ID NO: 1962 - DNA, 14 bp, synthetic construct
  source 1..14: mol_type = other DNA
ctttcttctgaaga

SEQ ID NO: 1963 - DNA, 14 bp, synthetic construct
  source 1..14: mol_type = other DNA
ggctttctagtgtg

SEQ ID NO: 1964 - DNA, 14 bp, synthetic construct
  source 1..14: mol_type = other DNA
tatggaaactcttt

SEQ ID NO: 1965 - DNA, 14 bp, synthetic construct
  source 1..14: mol_type = other DNA
tgttagatgtggta

SEQ ID NO: 1966 - DNA, 14 bp, synthetic construct
  source 1..14: mol_type = other DNA
ttgcattggtcctc

SEQ ID NO: 1967 - DNA, 14 bp, synthetic construct
  source 1..14: mol_type = other DNA
gcgcgttttatcat

SEQ ID NO: 1968 - DNA, 14 bp, synthetic construct
  source 1..14: mol_type = other DNA
ctagattgtctgtc

SEQ ID NO: 1969 - DNA, 14 bp, synthetic construct
  source 1..14: mol_type = other DNA
ctaaagatcctttt

SEQ ID NO: 1970 - DNA, 14 bp, synthetic construct
  source 1..14: mol_type = other DNA
tcgttcttgagctc

SEQ ID NO: 1971 - DNA, 14 bp, synthetic construct
  source 1..14: mol_type = other DNA
ttattcaagttgca

SEQ ID NO: 1972 - DNA, 14 bp, synthetic construct
  source 1..14: mol_type = other DNA
gccgtttacgtttc

SEQ ID NO: 1973 - DNA, 14 bp, synthetic construct
  source 1..14: mol_type = other DNA
tcgtttactctcga

SEQ ID NO: 1974 - DNA, 14 bp, synthetic construct
  source 1..14: mol_type = other DNA
atcgtttccttgga

SEQ ID NO: 1975 - DNA, 14 bp, synthetic construct
  source 1..14: mol_type = other DNA
tattgcatctcact

SEQ ID NO: 1976 - DNA, 14 bp, synthetic construct
  source 1..14: mol_type = other DNA
ttgtgagtcatgct

SEQ ID NO: 1977 - DNA, 14 bp, synthetic construct
  source 1..14: mol_type = other DNA
tgttgatgccttga

SEQ ID NO: 1978 - DNA, 14 bp, synthetic construct
  source 1..14: mol_type = other DNA
gtagttttagctcc

SEQ ID NO: 1979 - DNA, 14 bp, synthetic construct
  source 1..14: mol_type = other DNA
attcatttgaacct

SEQ ID NO: 1980 - DNA, 14 bp, synthetic construct
  source 1..14: mol_type = other DNA
gtccctcttgttag

SEQ ID NO: 1981 - DNA, 14 bp, synthetic construct
  source 1..14: mol_type = other DNA
ctttcgtcactggt

SEQ ID NO: 1982 - DNA, 14 bp, synthetic construct
  source 1..14: mol_type = other DNA
agctattagatttg

SEQ ID NO: 1983 - DNA, 14 bp, synthetic construct
  source 1..14: mol_type = other DNA
tatggcatagattt

SEQ ID NO: 1984 - DNA, 14 bp, synthetic construct
  source 1..14: mol_type = other DNA
gttttgggggttgg

SEQ ID NO: 1985 - DNA, 14 bp, synthetic construct
  source 1..14: mol_type = other DNA
ttgtaggttactag

SEQ ID NO: 1986 - DNA, 14 bp, synthetic construct
  source 1..14: mol_type = other DNA
gtcttgcgcgttta

SEQ ID NO: 1987 - DNA, 14 bp, synthetic construct
  source 1..14: mol_type = other DNA
acgtatgttactgt

SEQ ID NO: 1988 - DNA, 14 bp, synthetic construct
  source 1..14: mol_type = other DNA
tcctgatatacttg

SEQ ID NO: 1989 - DNA, 14 bp, synthetic construct
  source 1..14: mol_type = other DNA
gttttctaaatgac

SEQ ID NO: 1990 - DNA, 14 bp, synthetic construct
  source 1..14: mol_type = other DNA
aaagtagcttattt

SEQ ID NO: 1991 - DNA, 14 bp, synthetic construct
  source 1..14: mol_type = other DNA
tgtgtgaatgtact

SEQ ID NO: 1992 - DNA, 14 bp, synthetic construct
  source 1..14: mol_type = other DNA
ttcactgattgact

SEQ ID NO: 1993 - DNA, 14 bp, synthetic construct
  source 1..14: mol_type = other DNA
gtttactttggcgc

SEQ ID NO: 1994 - DNA, 14 bp, synthetic construct
  source 1..14: mol_type = other DNA
aaggtaatctgttt

SEQ ID NO: 1995 - DNA, 14 bp, synthetic construct
  source 1..14: mol_type = other DNA
atgagtagattttg

SEQ ID NO: 1996 - DNA, 14 bp, synthetic construct
  source 1..14: mol_type = other DNA
ttttcaaccctatg

SEQ ID NO: 1997 - DNA, 14 bp, synthetic construct
  source 1..14: mol_type = other DNA
tccattcgtgatat

SEQ ID NO: 1998 - DNA, 14 bp, synthetic construct
  source 1..14: mol_type = other DNA
tgaatcactctgtt

SEQ ID NO: 1999 - DNA, 14 bp, synthetic construct
  source 1..14: mol_type = other DNA
tttgtggaatagtc

SEQ ID NO: 2000 - DNA, 14 bp, synthetic construct
  source 1..14: mol_type = other DNA
gtacgttttcacct

SEQ ID NO: 2001 - DNA, 14 bp, synthetic construct
  source 1..14: mol_type = other DNA
ttctcgatccgttc

SEQ ID NO: 2002 - DNA, 14 bp, synthetic construct
  source 1..14: mol_type = other DNA
atttatggtggtga

SEQ ID NO: 2003 - DNA, 14 bp, synthetic construct
  source 1..14: mol_type = other DNA
cttaagcttattaa

SEQ ID NO: 2004 - DNA, 14 bp, synthetic construct
  source 1..14: mol_type = other DNA
agattctgatgtat

SEQ ID NO: 2005 - DNA, 14 bp, synthetic construct
  source 1..14: mol_type = other DNA
tttaaaggtatgtg

SEQ ID NO: 2006 - DNA, 14 bp, synthetic construct
  source 1..14: mol_type = other DNA
ttggttcgcactat

SEQ ID NO: 2007 - DNA, 14 bp, synthetic construct
  source 1..14: mol_type = other DNA
tagttctcataaat

SEQ ID NO: 2008 - DNA, 14 bp, synthetic construct
  source 1..14: mol_type = other DNA
atattgtacttcgc

SEQ ID NO: 2009 - DNA, 14 bp, synthetic construct
  source 1..14: mol_type = other DNA
ctagctgtcctttc

SEQ ID NO: 2010 - DNA, 14 bp, synthetic construct
  source 1..14: mol_type = other DNA
ctttatggccgttc

SEQ ID NO: 2011 - DNA, 14 bp, synthetic construct
  source 1..14: mol_type = other DNA
tggtcttaacttca

SEQ ID NO: 2012 - DNA, 14 bp, synthetic construct
  source 1..14: mol_type = other DNA
cattctagggttct

SEQ ID NO: 2013 - DNA, 14 bp, synthetic construct
  source 1..14: mol_type = other DNA
tttgcatccacttg

SEQ ID NO: 2014 - DNA, 14 bp, synthetic construct
  source 1..14: mol_type = other DNA
gtatgaagttttcg

SEQ ID NO: 2015 - DNA, 14 bp, synthetic construct
  source 1..14: mol_type = other DNA
tttacagttcatca

SEQ ID NO: 2016 - DNA, 14 bp, synthetic construct
  source 1..14: mol_type = other DNA
tttagattcccaat

SEQ ID NO: 2017 - DNA, 14 bp, synthetic construct
  source 1..14: mol_type = other DNA
ttagctagtttgga

SEQ ID NO: 2018 - DNA, 14 bp, synthetic construct
  source 1..14: mol_type = other DNA
tcgtgtcattagta

SEQ ID NO: 2019 - DNA, 14 bp, synthetic construct
  source 1..14: mol_type = other DNA
gttttccagtctgt

SEQ ID NO: 2020 - DNA, 14 bp, synthetic construct
  source 1..14: mol_type = other DNA
gttatttgttcgag

SEQ ID NO: 2021 - DNA, 14 bp, synthetic construct
  source 1..14: mol_type = other DNA
agtagttttccttg

SEQ ID NO: 2022 - DNA, 14 bp, synthetic construct
  source 1..14: mol_type = other DNA
tcatttctgttcca

SEQ ID NO: 2023 - DNA, 14 bp, synthetic construct
  source 1..14: mol_type = other DNA
gtatgcattatttc

SEQ ID NO: 2024 - DNA, 14 bp, synthetic construct
  source 1..14: mol_type = other DNA
tgttagtggtctct

SEQ ID NO: 2025 - DNA, 14 bp, synthetic construct
  source 1..14: mol_type = other DNA
atgttgatccttat

SEQ ID NO: 2026 - DNA, 14 bp, synthetic construct
  source 1..14: mol_type = other DNA
tctttctctaatgc

SEQ ID NO: 2027 - DNA, 14 bp, synthetic construct
  source 1..14: mol_type = other DNA
ttggtattcctatc

SEQ ID NO: 2028 - DNA, 14 bp, synthetic construct
  source 1..14: mol_type = other DNA
cttgtgattctgta

SEQ ID NO: 2029 - DNA, 14 bp, synthetic construct
  source 1..14: mol_type = other DNA
ttattactcggatt

SEQ ID NO: 2030 - DNA, 14 bp, synthetic construct
  source 1..14: mol_type = other DNA
atttgtgggattgt

SEQ ID NO: 2031 - DNA, 14 bp, synthetic construct
  source 1..14: mol_type = other DNA
tacttgatgtcctt

SEQ ID NO: 2032 - DNA, 14 bp, synthetic construct
  source 1..14: mol_type = other DNA
gtaggctcattttt

SEQ ID NO: 2033 - DNA, 14 bp, synthetic construct
  source 1..14: mol_type = other DNA
ctttcatttagtag

SEQ ID NO: 2034 - DNA, 14 bp, synthetic construct
  source 1..14: mol_type = other DNA
ggattcttttaagt

SEQ ID NO: 2035 - DNA, 14 bp, synthetic construct
  source 1..14: mol_type = other DNA
atttcttgactact

SEQ ID NO: 2036 - DNA, 14 bp, synthetic construct
  source 1..14: mol_type = other DNA
tcatggtatttgct

SEQ ID NO: 2037 - DNA, 14 bp, synthetic construct
  source 1..14: mol_type = other DNA
catttatgttccgt

SEQ ID NO: 2038 - DNA, 14 bp, synthetic construct
  source 1..14: mol_type = other DNA
ttcgtgttaattgc

SEQ ID NO: 2039 - DNA, 14 bp, synthetic construct
  source 1..14: mol_type = other DNA
atctaggtttgtgt

SEQ ID NO: 2040 - DNA, 14 bp, synthetic construct
  source 1..14: mol_type = other DNA
gtatgattctctta

SEQ ID NO: 2041 - DNA, 14 bp, synthetic construct
  source 1..14: mol_type = other DNA
tcctgtttcttaga

SEQ ID NO: 2042 - DNA, 14 bp, synthetic construct
  source 1..14: mol_type = other DNA
ttcatgtttcactc

SEQ ID NO: 2043 - DNA, 14 bp, synthetic construct
  source 1..14: mol_type = other DNA
ctggttattccctt

SEQ ID NO: 2044 - DNA, 14 bp, synthetic construct
  source 1..14: mol_type = other DNA
acccttctattttg

SEQ ID NO: 2045 - DNA, 14 bp, synthetic construct
  source 1..14: mol_type = other DNA
ccgtttcgctttgt

SEQ ID NO: 2046 - DNA, 14 bp, synthetic construct
  source 1..14: mol_type = other DNA
atgattctttcagt

SEQ ID NO: 2047 - DNA, 14 bp, synthetic construct
  source 1..14: mol_type = other DNA
ttggtttgctgtga

SEQ ID NO: 2048 - DNA, 14 bp, synthetic construct
  source 1..14: mol_type = other DNA
gtctggtatattgt

SEQ ID NO: 2049 - DNA, 14 bp, synthetic construct
  source 1..14: mol_type = other DNA
attgcatcatttct

SEQ ID NO: 2050 - DNA, 14 bp, synthetic construct
  source 1..14: mol_type = other DNA
ttggatttttggac

SEQ ID NO: 2051 - DNA, 14 bp, synthetic construct
  source 1..14: mol_type = other DNA
ccctttttgaactt

SEQ ID NO: 2052 - DNA, 14 bp, synthetic construct
  source 1..14: mol_type = other DNA
ctcttagtgtttcc

SEQ ID NO: 2053 - DNA, 14 bp, synthetic construct
  source 1..14: mol_type = other DNA
tcgttcctttccgt

SEQ ID NO: 2054 - DNA, 14 bp, synthetic construct
  source 1..14: mol_type = other DNA
tgttacggttttcg

SEQ ID NO: 2055 - DNA, 14 bp, synthetic construct
  source 1..14: mol_type = other DNA
ttcctttttagaac

SEQ ID NO: 2056 - DNA, 14 bp, synthetic construct
  source 1..14: mol_type = other DNA
tggttagtttaatc

SEQ ID NO: 2057 - DNA, 14 bp, synthetic construct
  source 1..14: mol_type = other DNA
cttagtcttgtctc

SEQ ID NO: 2058 - DNA, 14 bp, synthetic construct
  source 1..14: mol_type = other DNA
tgttgttatcaatg

SEQ ID NO: 2059 - DNA, 14 bp, synthetic construct
  source 1..14: mol_type = other DNA
atttttagatcgtg

SEQ ID NO: 2060 - DNA, 14 bp, synthetic construct
  source 1..14: mol_type = other DNA
ttgtttatggtgga

SEQ ID NO: 2061 - DNA, 14 bp, synthetic construct
  source 1..14: mol_type = other DNA
tacatagagttttt

SEQ ID NO: 2062 - DNA, 14 bp, synthetic construct
  source 1..14: mol_type = other DNA
ttttccttcgcgtc

SEQ ID NO: 2063 - DNA, 14 bp, synthetic construct
  source 1..14: mol_type = other DNA
cggttttattactg

SEQ ID NO: 2064 - DNA, 14 bp, synthetic construct
  source 1..14: mol_type = other DNA
taatagtgctttta

SEQ ID NO: 2065 - DNA, 14 bp, synthetic construct
  source 1..14: mol_type = other DNA
gttgatatgtatat

SEQ ID NO: 2066 - DNA, 14 bp, synthetic construct
  source 1..14: mol_type = other DNA
caagttgatttctt

SEQ ID NO: 2067 - DNA, 14 bp, synthetic construct
  source 1..14: mol_type = other DNA
ttattgtcttcaca

SEQ ID NO: 2068 - DNA, 14 bp, synthetic construct
  source 1..14: mol_type = other DNA
aggtattttgtgtg

SEQ ID NO: 2069 - DNA, 14 bp, synthetic construct
  source 1..14: mol_type = other DNA
cctctcctctttat

SEQ ID NO: 2070 - DNA, 14 bp, synthetic construct
  source 1..14: mol_type = other DNA
tttaggttggtcta

SEQ ID NO: 2071 - DNA, 14 bp, synthetic construct
  source 1..14: mol_type = other DNA
cggtctctttgttc

SEQ ID NO: 2072 - DNA, 14 bp, synthetic construct
  source 1..14: mol_type = other DNA
tgttatgtaacctt

SEQ ID NO: 2073 - DNA, 14 bp, synthetic construct
  source 1..14: mol_type = other DNA
ctttattcgagtct

SEQ ID NO: 2074 - DNA, 14 bp, synthetic construct
  source 1..14: mol_type = other DNA
ggtatactttcctt

SEQ ID NO: 2075 - DNA, 14 bp, synthetic construct
  source 1..14: mol_type = other DNA
cagcttgtgttgtt

SEQ ID NO: 2076 - DNA, 14 bp, synthetic construct
  source 1..14: mol_type = other DNA
ttgcgctttcgctt

SEQ ID NO: 2077 - DNA, 14 bp, synthetic construct
  source 1..14: mol_type = other DNA
tagtctatttgact

SEQ ID NO: 2078 - DNA, 14 bp, synthetic construct
  source 1..14: mol_type = other DNA
gtcgttggtttttg

SEQ ID NO: 2079 - DNA, 14 bp, synthetic construct
  source 1..14: mol_type = other DNA
ggtttattgattta

SEQ ID NO: 2080 - DNA, 14 bp, synthetic construct
  source 1..14: mol_type = other DNA
gtttttatgctata

SEQ ID NO: 2081 - DNA, 14 bp, synthetic construct
  source 1..14: mol_type = other DNA
tgctattttcggtt

SEQ ID NO: 2082 - DNA, 14 bp, synthetic construct
  source 1..14: mol_type = other DNA
tattgtcttttcac

SEQ ID NO: 2083 - DNA, 14 bp, synthetic construct
  source 1..14: mol_type = other DNA
ttgtcctgggtttt

SEQ ID NO: 2084 - DNA, 14 bp, synthetic construct
  source 1..14: mol_type = other DNA
tcttttggctgttg

SEQ ID NO: 2085 - DNA, 14 bp, synthetic construct
  source 1..14: mol_type = other DNA
acttcgactttttt

SEQ ID NO: 2086 - DNA, 14 bp, synthetic construct
  source 1..14: mol_type = other DNA
tgcttttcttacct

SEQ ID NO: 2087 - DNA, 14 bp, synthetic construct
  source 1..14: mol_type = other DNA
atgatcctttttta

SEQ ID NO: 2088 - DNA, 14 bp, synthetic construct
  source 1..14: mol_type = other DNA
tttctattgtgtgc

SEQ ID NO: 2089 - DNA, 14 bp, synthetic construct
  source 1..14: mol_type = other DNA
tatttcctatactt

SEQ ID NO: 2090 - DNA, 14 bp, synthetic construct
  source 1..14: mol_type = other DNA
gtttgtttattgag

SEQ ID NO: 2091 - DNA, 14 bp, synthetic construct
  source 1..14: mol_type = other DNA
ggattgttttcttc

SEQ ID NO: 2092 - DNA, 14 bp, synthetic construct
  source 1..14: mol_type = other DNA
tgtatccattttgt

SEQ ID NO: 2093 - DNA, 14 bp, synthetic construct
  source 1..14: mol_type = other DNA
cctattttctcgtt

SEQ ID NO: 2094 - DNA, 14 bp, synthetic construct
  source 1..14: mol_type = other DNA
attcttactgtatt

SEQ ID NO: 2095 - DNA, 14 bp, synthetic construct
  source 1..14: mol_type = other DNA
ttgagtttatcttc

SEQ ID NO: 2096 - DNA, 14 bp, synthetic construct
  source 1..14: mol_type = other DNA
cttcttctcttctg

SEQ ID NO: 2097 - DNA, 14 bp, synthetic construct
  source 1..14: mol_type = other DNA
ttgtgttctataat

SEQ ID NO: 2098 - DNA, 14 bp, synthetic construct
  source 1..14: mol_type = other DNA
gtttgaaatctttt

SEQ ID NO: 2099 - DNA, 14 bp, synthetic construct
  source 1..14: mol_type = other DNA
gtcctttgatgttt

SEQ ID NO: 2100 - DNA, 14 bp, synthetic construct
  source 1..14: mol_type = other DNA
tgtatattgttgct

SEQ ID NO: 2101 - DNA, 14 bp, synthetic construct
  source 1..14: mol_type = other DNA
ttgtctcgttgtgt

SEQ ID NO: 2102 - DNA, 14 bp, synthetic construct
  source 1..14: mol_type = other DNA
tcgtactatttttc

SEQ ID NO: 2103 - DNA, 14 bp, synthetic construct
  source 1..14: mol_type = other DNA
cttttattacctta

SEQ ID NO: 2104 - DNA, 14 bp, synthetic construct
  source 1..14: mol_type = other DNA
tcagtcttgctttt

SEQ ID NO: 2105 - DNA, 14 bp, synthetic construct
  source 1..14: mol_type = other DNA
ggcagcaactcggg

SEQ ID NO: 2106 - DNA, 14 bp, synthetic construct
  source 1..14: mol_type = other DNA
ccgcctacagaggg

SEQ ID NO: 2107 - DNA, 14 bp, synthetic construct
  source 1..14: mol_type = other DNA
ggagataggcgccc

SEQ ID NO: 2108 - DNA, 14 bp, synthetic construct
  source 1..14: mol_type = other DNA
caagtggccggcgg

SEQ ID NO: 2109 - DNA, 14 bp, synthetic construct
  source 1..14: mol_type = other DNA
gcgacgaggccact

SEQ ID NO: 2110 - DNA, 14 bp, synthetic construct
  source 1..14: mol_type = other DNA
agcgagacggtgcc

SEQ ID NO: 2111 - DNA, 14 bp, synthetic construct
  source 1..14: mol_type = other DNA
tcggcagaacgccg

SEQ ID NO: 2112 - DNA, 14 bp, synthetic construct
  source 1..14: mol_type = other DNA
ccgaaccgggtgaa

SEQ ID NO: 2113 - DNA, 14 bp, synthetic construct
  source 1..14: mol_type = other DNA
gaccaatacacgcc

SEQ ID NO: 2114 - DNA, 14 bp, synthetic construct
  source 1..14: mol_type = other DNA
aggagccggtaaaa

SEQ ID NO: 2115 - DNA, 14 bp, synthetic construct
  source 1..14: mol_type = other DNA
cagtagcccgagaa

SEQ ID NO: 2116 - DNA, 14 bp, synthetic construct
  source 1..14: mol_type = other DNA
cgcacacatcacgc

SEQ ID NO: 2117 - DNA, 14 bp, synthetic construct
  source 1..14: mol_type = other DNA
gctcagcgccaaag

SEQ ID NO: 2118 - DNA, 14 bp, synthetic construct
  source 1..14: mol_type = other DNA
gagaaacaagatgc

SEQ ID NO: 2119 - DNA, 14 bp, synthetic construct
  source 1..14: mol_type = other DNA
ccaaataacaaaag

SEQ ID NO: 2120 - DNA, 14 bp, synthetic construct
  source 1..14: mol_type = other DNA
aacagcgacacggt

SEQ ID NO: 2121 - DNA, 14 bp, synthetic construct
  source 1..14: mol_type = other DNA
accaagacgaccat

SEQ ID NO: 2122 - DNA, 14 bp, synthetic construct
  source 1..14: mol_type = other DNA
gcaagaccctcacc

SEQ ID NO: 2123 - DNA, 14 bp, synthetic construct
  source 1..14: mol_type = other DNA
accatcaccaagcc

SEQ ID NO: 2124 - DNA, 14 bp, synthetic construct
  source 1..14: mol_type = other DNA
cgagaccctccaga

SEQ ID NO: 2125 - DNA, 14 bp, synthetic construct
  source 1..14: mol_type = other DNA
gctccaggcagcca

SEQ ID NO: 2126 - DNA, 14 bp, synthetic construct
  source 1..14: mol_type = other DNA
agctgaggaccaag

SEQ ID NO: 2127 - DNA, 14 bp, synthetic construct
  source 1..14: mol_type = other DNA
ccaccctggacacg

SEQ ID NO: 2128 - DNA, 14 bp, synthetic construct
  source 1..14: mol_type = other DNA
ccaggaaacaccta

SEQ ID NO: 2129 - DNA, 14 bp, synthetic construct
  source 1..14: mol_type = other DNA
caggaatccggcca

SEQ ID NO: 2130 - DNA, 14 bp, synthetic construct
  source 1..14: mol_type = other DNA
gtggccgaggcagg

SEQ ID NO: 2131 - DNA, 14 bp, synthetic construct
  source 1..14: mol_type = other DNA
caaggcagcggtgc

SEQ ID NO: 2132 - DNA, 14 bp, synthetic construct
  source 1..14: mol_type = other DNA
aagccgcacactcc

SEQ ID NO: 2133 - DNA, 14 bp, synthetic construct
  source 1..14: mol_type = other DNA
agccaggcaactac

SEQ ID NO: 2134 - DNA, 14 bp, synthetic construct
  source 1..14: mol_type = other DNA
ctccaagccccgga

SEQ ID NO: 2135 - DNA, 14 bp, synthetic construct
  source 1..14: mol_type = other DNA
cgtgaaccccaccc

SEQ ID NO: 2136 - DNA, 14 bp, synthetic construct
  source 1..14: mol_type = other DNA
gtacaagccggcca

SEQ ID NO: 2137 - DNA, 14 bp, synthetic construct
  source 1..14: mol_type = other DNA
acagacgaacactc

SEQ ID NO: 2138 - DNA, 14 bp, synthetic construct
  source 1..14: mol_type = other DNA
caaacaaagcgatg

SEQ ID NO: 2139 - DNA, 14 bp, synthetic construct
  source 1..14: mol_type = other DNA
aagcggtgacaggc

SEQ ID NO: 2140 - DNA, 14 bp, synthetic construct
  source 1..14: mol_type = other DNA
tagcacgccgacag

SEQ ID NO: 2141 - DNA, 14 bp, synthetic construct
  source 1..14: mol_type = other DNA
gtaccccagcggac

SEQ ID NO: 2142 - DNA, 14 bp, synthetic construct
  source 1..14: mol_type = other DNA
cacaggcggtgggc

SEQ ID NO: 2143 - DNA, 14 bp, synthetic construct
  source 1..14: mol_type = other DNA
cacaggagacactc

SEQ ID NO: 2144 - DNA, 14 bp, synthetic construct
  source 1..14: mol_type = other DNA
aagcaccatgcgga

SEQ ID NO: 2145 - DNA, 14 bp, synthetic construct
  source 1..14: mol_type = other DNA
gcactaccaggcaa

SEQ ID NO: 2146 - DNA, 14 bp, synthetic construct
  source 1..14: mol_type = other DNA
ggcgagggaggtca

SEQ ID NO: 2147 - DNA, 14 bp, synthetic construct
  source 1..14: mol_type = other DNA
ggtacaaacaaccg

SEQ ID NO: 2148 - DNA, 14 bp, synthetic construct
  source 1..14: mol_type = other DNA
ggcactgctgacaa

SEQ ID NO: 2149 - DNA, 14 bp, synthetic construct
  source 1..14: mol_type = other DNA
ctaaccacactcaa

SEQ ID NO: 2150 - DNA, 14 bp, synthetic construct
  source 1..14: mol_type = other DNA
cgctgcatgggacc

SEQ ID NO: 2151 - DNA, 14 bp, synthetic construct
  source 1..14: mol_type = other DNA
gagcatacgcatag

SEQ ID NO: 2152 - DNA, 14 bp, synthetic construct
  source 1..14: mol_type = other DNA
aagacctaaagact

SEQ ID NO: 2153 - DNA, 14 bp, synthetic construct
  source 1..14: mol_type = other DNA
ggccaaatccactg

SEQ ID NO: 2154 - DNA, 14 bp, synthetic construct
  source 1..14: mol_type = other DNA
aattggaacgcgcc

SEQ ID NO: 2155 - DNA, 14 bp, synthetic construct
  source 1..14: mol_type = other DNA
cgcgagctaccggt

SEQ ID NO: 2156 - DNA, 14 bp, synthetic construct
  source 1..14: mol_type = other DNA
atcgcagggcgtgc

SEQ ID NO: 2157 - DNA, 14 bp, synthetic construct
  source 1..14: mol_type = other DNA
agggaccttcaaca

SEQ ID NO: 2158 - DNA, 14 bp, synthetic construct
  source 1..14: mol_type = other DNA
agagacctcggctg

SEQ ID NO: 2159 - DNA, 14 bp, synthetic construct
  source 1..14: mol_type = other DNA
cccgacccgttcag

SEQ ID NO: 2160 - DNA, 14 bp, synthetic construct
  source 1..14: mol_type = other DNA
acttcaccgcaaag

SEQ ID NO: 2161 - DNA, 14 bp, synthetic construct
  source 1..14: mol_type = other DNA
atgaaaaactggcc

SEQ ID NO: 2162 - DNA, 14 bp, synthetic construct
  source 1..14: mol_type = other DNA
cgcgtacgctaacg

SEQ ID NO: 2163 - DNA, 14 bp, synthetic construct
  source 1..14: mol_type = other DNA
gctcccgctcagga

SEQ ID NO: 2164 - DNA, 14 bp, synthetic construct
  source 1..14: mol_type = other DNA
agtcgacctgagca

SEQ ID NO: 2165 - DNA, 14 bp, synthetic construct
  source 1..14: mol_type = other DNA
aaacgaagcggctt

SEQ ID NO: 2166 - DNA, 14 bp, synthetic construct
  source 1..14: mol_type = other DNA
cgcaactaggatac

SEQ ID NO: 2167 - DNA, 14 bp, synthetic construct
  source 1..14: mol_type = other DNA
cgtatggaaaacag

SEQ ID NO: 2168 - DNA, 14 bp, synthetic construct
  source 1..14: mol_type = other DNA
cgcagtcggtccag

SEQ ID NO: 2169 - DNA, 14 bp, synthetic construct
  source 1..14: mol_type = other DNA
aagcgtcgtacggg

SEQ ID NO: 2170 - DNA, 14 bp, synthetic construct
  source 1..14: mol_type = other DNA
gccggtgcgtaaac

SEQ ID NO: 2171 - DNA, 14 bp, synthetic construct
  source 1..14: mol_type = other DNA
ggactacacacgtg

SEQ ID NO: 2172 - DNA, 14 bp, synthetic construct
  source 1..14: mol_type = other DNA
cgtgaacgaagtca

SEQ ID NO: 2173 - DNA, 14 bp, synthetic construct
  source 1..14: mol_type = other DNA
cataccggacacct

SEQ ID NO: 2174 - DNA, 14 bp, synthetic construct
  source 1..14: mol_type = other DNA
cagtaagcccaatg

SEQ ID NO: 2175 - DNA, 14 bp, synthetic construct
  source 1..14: mol_type = other DNA
ctcgaagcctacgg

SEQ ID NO: 2176 - DNA, 14 bp, synthetic construct
  source 1..14: mol_type = other DNA
ggaatggcgtacca

SEQ ID NO: 2177 - DNA, 14 bp, synthetic construct
  source 1..14: mol_type = other DNA
ggtcgagggacgta

SEQ ID NO: 2178 - DNA, 14 bp, synthetic construct
  source 1..14: mol_type = other DNA
acgtgagatagcac

SEQ ID NO: 2179 - DNA, 14 bp, synthetic construct
  source 1..14: mol_type = other DNA
tgagacatcccgag

SEQ ID NO: 2180 - DNA, 14 bp, synthetic construct
  source 1..14: mol_type = other DNA
gtccgcgataagcg

SEQ ID NO: 2181 - DNA, 14 bp, synthetic construct
  source 1..14: mol_type = other DNA
gaactggctcaagg

SEQ ID NO: 2182 - DNA, 14 bp, synthetic construct
  source 1..14: mol_type = other DNA
cataggtagggcac

SEQ ID NO: 2183 - DNA, 14 bp, synthetic construct
  source 1..14: mol_type = other DNA
caatgatgcgaaac

SEQ ID NO: 2184 - DNA, 14 bp, synthetic construct
  source 1..14: mol_type = other DNA
gtgcccgtcccaag

SEQ ID NO: 2185 - DNA, 14 bp, synthetic construct
  source 1..14: mol_type = other DNA
acgacacgcgttga

SEQ ID NO: 2186 - DNA, 14 bp, synthetic construct
  source 1..14: mol_type = other DNA
cttcagacaaacac

SEQ ID NO: 2187 - DNA, 14 bp, synthetic construct
  source 1..14: mol_type = other DNA
gagaagaagcttac

SEQ ID NO: 2188 - DNA, 14 bp, synthetic construct
  source 1..14: mol_type = other DNA
ggaggtctaagcgg

SEQ ID NO: 2189 - DNA, 14 bp, synthetic construct
  source 1..14: mol_type = other DNA
aagcccgacatgta

SEQ ID NO: 2190 - DNA, 14 bp, synthetic construct
  source 1..14: mol_type = other DNA
gaagcgaggttcca

SEQ ID NO: 2191 - DNA, 14 bp, synthetic construct
  source 1..14: mol_type = other DNA
accgatcgtatcgc

SEQ ID NO: 2192 - DNA, 14 bp, synthetic construct
  source 1..14: mol_type = other DNA
ctatacggcctacc

SEQ ID NO: 2193 - DNA, 14 bp, synthetic construct
  source 1..14: mol_type = other DNA
gctaacacggcttc

SEQ ID NO: 2194 - DNA, 14 bp, synthetic construct
  source 1..14: mol_type = other DNA
acgtaggagcgtat

SEQ ID NO: 2195 - DNA, 14 bp, synthetic construct
  source 1..14: mol_type = other DNA
ggatgggctagatc

SEQ ID NO: 2196 - DNA, 14 bp, synthetic construct
  source 1..14: mol_type = other DNA
cctaatgtggccca

SEQ ID NO: 2197 - DNA, 14 bp, synthetic construct
  source 1..14: mol_type = other DNA
ggtgagttacacac

SEQ ID NO: 2198 - DNA, 14 bp, synthetic construct
  source 1..14: mol_type = other DNA
aagctacctcacct

SEQ ID NO: 2199 - DNA, 14 bp, synthetic construct
  source 1..14: mol_type = other DNA
gcacattcgatgac

SEQ ID NO: 2200 - DNA, 14 bp, synthetic construct
  source 1..14: mol_type = other DNA
caatcgctaatcgc

SEQ ID NO: 2201 - DNA, 14 bp, synthetic construct
  source 1..14: mol_type = other DNA
gcgctggcttcgga

SEQ ID NO: 2202 - DNA, 14 bp, synthetic construct
  source 1..14: mol_type = other DNA
tgcgtcgggtaaca

SEQ ID NO: 2203 - DNA, 14 bp, synthetic construct
  source 1..14: mol_type = other DNA
ctgggaacagttcc

SEQ ID NO: 2204 - DNA, 14 bp, synthetic construct
  source 1..14: mol_type = other DNA
agagctgcactggt

SEQ ID NO: 2205 - DNA, 14 bp, synthetic construct
  source 1..14: mol_type = other DNA
gaactaacttgccc

SEQ ID NO: 2206 - DNA, 14 bp, synthetic construct
  source 1..14: mol_type = other DNA
tgagtacccagcct

SEQ ID NO: 2207 - DNA, 14 bp, synthetic construct
  source 1..14: mol_type = other DNA
ctcgctgacggctg

SEQ ID NO: 2208 - DNA, 14 bp, synthetic construct
  source 1..14: mol_type = other DNA
ccaatatccgcatg

SEQ ID NO: 2209 - DNA, 14 bp, synthetic construct
  source 1..14: mol_type = other DNA
tagaatgacaatga

SEQ ID NO: 2210 - DNA, 14 bp, synthetic construct
  source 1..14: mol_type = other DNA
tcagcgtagtagga

SEQ ID NO: 2211 - DNA, 14 bp, synthetic construct
  source 1..14: mol_type = other DNA
taccgcgactccat

SEQ ID NO: 2212 - DNA, 14 bp, synthetic construct
  source 1..14: mol_type = other DNA
ctaggtactcgcca

SEQ ID NO: 2213 - DNA, 14 bp, synthetic construct
  source 1..14: mol_type = other DNA
ccgtcggtgtcgcg

SEQ ID NO: 2214 - DNA, 14 bp, synthetic construct
  source 1..14: mol_type = other DNA
gaagacctacggtt

SEQ ID NO: 2215 - DNA, 14 bp, synthetic construct
  source 1..14: mol_type = other DNA
gaatgtcactgaaa

SEQ ID NO: 2216 - DNA, 14 bp, synthetic construct
  source 1..14: mol_type = other DNA
acaaactaaatcct

SEQ ID NO: 2217 - DNA, 14 bp, synthetic construct
  source 1..14: mol_type = other DNA
tgtggtggcggcca

SEQ ID NO: 2218 - DNA, 14 bp, synthetic construct
  source 1..14: mol_type = other DNA
tatatccgcaaccc

SEQ ID NO: 2219 - DNA, 14 bp, synthetic construct
  source 1..14: mol_type = other DNA
tcgctataaggaca

SEQ ID NO: 2220 - DNA, 14 bp, synthetic construct
  source 1..14: mol_type = other DNA
atccagacgcgtta

SEQ ID NO: 2221 - DNA, 14 bp, synthetic construct
  source 1..14: mol_type = other DNA
catatcccaccata

SEQ ID NO: 2222 - DNA, 14 bp, synthetic construct
  source 1..14: mol_type = other DNA
tccgaggcccttga

SEQ ID NO: 2223 - DNA, 14 bp, synthetic construct
  source 1..14: mol_type = other DNA
caagctgggggtgt

SEQ ID NO: 2224 - DNA, 14 bp, synthetic construct
  source 1..14: mol_type = other DNA
gtgaaatcagtgag

SEQ ID NO: 2225 - DNA, 14 bp, synthetic construct
  source 1..14: mol_type = other DNA
gggattacataacg

SEQ ID NO: 2226 - DNA, 14 bp, synthetic construct
  source 1..14: mol_type = other DNA
gatccctgccggta

SEQ ID NO: 2227 - DNA, 14 bp, synthetic construct
  source 1..14: mol_type = other DNA
acactcccattgaa

SEQ ID NO: 2228 - DNA, 14 bp, synthetic construct
  source 1..14: mol_type = other DNA
ctggaccggagtta

SEQ ID NO: 2229 - DNA, 14 bp, synthetic construct
  source 1..14: mol_type = other DNA
cgacagcttatggc

SEQ ID NO: 2230 - DNA, 14 bp, synthetic construct
  source 1..14: mol_type = other DNA
aggtgggtgcctcc

SEQ ID NO: 2231 - DNA, 14 bp, synthetic construct
  source 1..14: mol_type = other DNA
acgaccgcctttag

SEQ ID NO: 2232 - DNA, 14 bp, synthetic construct
  source 1..14: mol_type = other DNA
tgggagtactgcca

SEQ ID NO: 2233 - DNA, 14 bp, synthetic construct
  source 1..14: mol_type = other DNA
gcgtaggatccatg

SEQ ID NO: 2234 - DNA, 14 bp, synthetic construct
  source 1..14: mol_type = other DNA
aatagtgcgctgaa

SEQ ID NO: 2235 - DNA, 14 bp, synthetic construct
  source 1..14: mol_type = other DNA
gacaggtatcaact

SEQ ID NO: 2236 - DNA, 14 bp, synthetic construct
  source 1..14: mol_type = other DNA
gaatcacttcaagc

SEQ ID NO: 2237 - DNA, 14 bp, synthetic construct
  source 1..14: mol_type = other DNA
cactataaaactgg

SEQ ID NO: 2238 - DNA, 14 bp, synthetic construct
  source 1..14: mol_type = other DNA
atggaaactacgct

SEQ ID NO: 2239 - DNA, 14 bp, synthetic construct
  source 1..14: mol_type = other DNA
gcgtcgcattgcgc

SEQ ID NO: 2240 - DNA, 14 bp, synthetic construct
  source 1..14: mol_type = other DNA
cctgggtatagcga

SEQ ID NO: 2241 - DNA, 14 bp, synthetic construct
  source 1..14: mol_type = other DNA
cggactgggtaatg

SEQ ID NO: 2242 - DNA, 14 bp, synthetic construct
  source 1..14: mol_type = other DNA
ccacctgtacggtc

SEQ ID NO: 2243 - DNA, 14 bp, synthetic construct
  source 1..14: mol_type = other DNA
gtggccatggatag

SEQ ID NO: 2244 - DNA, 14 bp, synthetic construct
  source 1..14: mol_type = other DNA
ccaagttacgagat

SEQ ID NO: 2245 - DNA, 14 bp, synthetic construct
  source 1..14: mol_type = other DNA
caagggtgagggtt

SEQ ID NO: 2246 - DNA, 14 bp, synthetic construct
  source 1..14: mol_type = other DNA
cgctaaggacgtgt

SEQ ID NO: 2247 - DNA, 14 bp, synthetic construct
  source 1..14: mol_type = other DNA
agttataagaagca

SEQ ID NO: 2248 - DNA, 14 bp, synthetic construct
  source 1..14: mol_type = other DNA
tgtgacagacgcta

SEQ ID NO: 2249 - DNA, 14 bp, synthetic construct
  source 1..14: mol_type = other DNA
ggagggcattgctg

SEQ ID NO: 2250 - DNA, 14 bp, synthetic construct
  source 1..14: mol_type = other DNA
ccctgtgataaagg

SEQ ID NO: 2251 - DNA, 14 bp, synthetic construct
  source 1..14: mol_type = other DNA
cgccttaaagctaa

SEQ ID NO: 2252 - DNA, 14 bp, synthetic construct
  source 1..14: mol_type = other DNA
cataagagtatgca

SEQ ID NO: 2253 - DNA, 14 bp, synthetic construct
  source 1..14: mol_type = other DNA
tgaagcgagagatt

SEQ ID NO: 2254 - DNA, 14 bp, synthetic construct
  source 1..14: mol_type = other DNA
acgagcgttcacat

SEQ ID NO: 2255 - DNA, 14 bp, synthetic construct
  source 1..14: mol_type = other DNA
gatgccaagtatcg

SEQ ID NO: 2256 - DNA, 14 bp, synthetic construct
  source 1..14: mol_type = other DNA
gggctgccccatgt

SEQ ID NO: 2257 - DNA, 14 bp, synthetic construct
  source 1..14: mol_type = other DNA
gcaacctaactagt

SEQ ID NO: 2258 - DNA, 14 bp, synthetic construct
  source 1..14: mol_type = other DNA
ctgcctctcggccg

SEQ ID NO: 2259 - DNA, 14 bp, synthetic construct
  source 1..14: mol_type = other DNA
cgcgcagtgttcgg

SEQ ID NO: 2260 - DNA, 14 bp, synthetic construct
  source 1..14: mol_type = other DNA
cgacggggttactc

SEQ ID NO: 2261 - DNA, 14 bp, synthetic construct
  source 1..14: mol_type = other DNA
gtgaaacttcggca

SEQ ID NO: 2262 - DNA, 14 bp, synthetic construct
  source 1..14: mol_type = other DNA
ctactaccctaccg

SEQ ID NO: 2263 - DNA, 14 bp, synthetic construct
  source 1..14: mol_type = other DNA
aactaagtatggga

SEQ ID NO: 2264 - DNA, 14 bp, synthetic construct
  source 1..14: mol_type = other DNA
ccggatgtgatggg

SEQ ID NO: 2265 - DNA, 14 bp, synthetic construct
  source 1..14: mol_type = other DNA
taaaacaacctgtg

SEQ ID NO: 2266 - DNA, 14 bp, synthetic construct
  source 1..14: mol_type = other DNA
caagaatatgtgca

SEQ ID NO: 2267 - DNA, 14 bp, synthetic construct
  source 1..14: mol_type = other DNA
caacgtggtcccgt

SEQ ID NO: 2268 - DNA, 14 bp, synthetic construct
  source 1..14: mol_type = other DNA
agtggaaagccttg

SEQ ID NO: 2269 - DNA, 14 bp, synthetic construct
  source 1..14: mol_type = other DNA
cccgatgtagcgat

SEQ ID NO: 2270 - DNA, 14 bp, synthetic construct
  source 1..14: mol_type = other DNA
caccgctctataag

SEQ ID NO: 2271 - DNA, 14 bp, synthetic construct
  source 1..14: mol_type = other DNA
cccgagttgtcaaa

SEQ ID NO: 2272 - DNA, 14 bp, synthetic construct
  source 1..14: mol_type = other DNA
aacgcccttcctca

SEQ ID NO: 2273 - DNA, 14 bp, synthetic construct
  source 1..14: mol_type = other DNA
atatccacggatga

SEQ ID NO: 2274 - DNA, 14 bp, synthetic construct
  source 1..14: mol_type = other DNA
actagatcatcgga

SEQ ID NO: 2275 - DNA, 14 bp, synthetic construct
  source 1..14: mol_type = other DNA
gtagcggcatggtc

SEQ ID NO: 2276 - DNA, 14 bp, synthetic construct
  source 1..14: mol_type = other DNA
ttgggcgaacacgt

SEQ ID NO: 2277 - DNA, 14 bp, synthetic construct
  source 1..14: mol_type = other DNA
ggttggtccacggt

SEQ ID NO: 2278 - DNA, 14 bp, synthetic construct
  source 1..14: mol_type = other DNA
atgggcctcaaatt

SEQ ID NO: 2279 - DNA, 14 bp, synthetic construct
  source 1..14: mol_type = other DNA
gatatcaccctgat

SEQ ID NO: 2280 - DNA, 14 bp, synthetic construct
  source 1..14: mol_type = other DNA
cgtggtaaccttcg

SEQ ID NO: 2281 - DNA, 14 bp, synthetic construct
  source 1..14: mol_type = other DNA
gctttatagcgaga

SEQ ID NO: 2282 - DNA, 14 bp, synthetic construct
  source 1..14: mol_type = other DNA
attctacgtgaacg

SEQ ID NO: 2283 - DNA, 14 bp, synthetic construct
  source 1..14: mol_type = other DNA
atggacatgtgatg

SEQ ID NO: 2284 - DNA, 14 bp, synthetic construct
  source 1..14: mol_type = other DNA
gtggggctctccct

SEQ ID NO: 2285 - DNA, 14 bp, synthetic construct
  source 1..14: mol_type = other DNA
cccgtcagtgctct

SEQ ID NO: 2286 - DNA, 14 bp, synthetic construct
  source 1..14: mol_type = other DNA
atatccaaagcctt

SEQ ID NO: 2287 - DNA, 14 bp, synthetic construct
  source 1..14: mol_type = other DNA
ttgctagaagcgtg

SEQ ID NO: 2288 - DNA, 14 bp, synthetic construct
  source 1..14: mol_type = other DNA
tagcttacaatccg

SEQ ID NO: 2289 - DNA, 14 bp, synthetic construct
  source 1..14: mol_type = other DNA
gggtcatccgtgct

SEQ ID NO: 2290 - DNA, 14 bp, synthetic construct
  source 1..14: mol_type = other DNA
agtgtcactatggg

SEQ ID NO: 2291 - DNA, 14 bp, synthetic construct
  source 1..14: mol_type = other DNA
tacgtagtagccat

SEQ ID NO: 2292 - DNA, 14 bp, synthetic construct
  source 1..14: mol_type = other DNA
ataccatggttaac

SEQ ID NO: 2293 - DNA, 14 bp, synthetic construct
  source 1..14: mol_type = other DNA
cttctccgatccaa

SEQ ID NO: 2294 - DNA, 14 bp, synthetic construct
  source 1..14: mol_type = other DNA
ggccttttaccccg

SEQ ID NO: 2295 - DNA, 14 bp, synthetic construct
  source 1..14: mol_type = other DNA
tgaaacttctcaac

SEQ ID NO: 2296 - DNA, 14 bp, synthetic construct
  source 1..14: mol_type = other DNA
ttagaactggatac

SEQ ID NO: 2297 - DNA, 14 bp, synthetic construct
  source 1..14: mol_type = other DNA
tgaacattagtaac

SEQ ID NO: 2298 - DNA, 14 bp, synthetic construct
  source 1..14: mol_type = other DNA
gaatgaatacctgt

SEQ ID NO: 2299 - DNA, 14 bp, synthetic construct
  source 1..14: mol_type = other DNA
aactcaatgccttg

SEQ ID NO: 2300 - DNA, 14 bp, synthetic construct
  source 1..14: mol_type = other DNA
gttgcgcagttgag

SEQ ID NO: 2301 - DNA, 14 bp, synthetic construct
  source 1..14: mol_type = other DNA
gcgtcgattgtacc

SEQ ID NO: 2302 - DNA, 14 bp, synthetic construct
  source 1..14: mol_type = other DNA
tcgaaaaagtgtat

SEQ ID NO: 2303 - DNA, 14 bp, synthetic construct
  source 1..14: mol_type = other DNA
gtcacgcggtcctt

SEQ ID NO: 2304 - DNA, 14 bp, synthetic construct
  source 1..14: mol_type = other DNA
tttaatcgaaagac

SEQ ID NO: 2305 - DNA, 14 bp, synthetic construct
  source 1..14: mol_type = other DNA
ctaggctggatact

SEQ ID NO: 2306 - DNA, 14 bp, synthetic construct
  source 1..14: mol_type = other DNA
aggagtcaatgctt

SEQ ID NO: 2307 - DNA, 14 bp, synthetic construct
  source 1..14: mol_type = other DNA
tctagggttaggca

SEQ ID NO: 2308 - DNA, 14 bp, synthetic construct
  source 1..14: mol_type = other DNA
ctcctcacaggtgt

SEQ ID NO: 2309 - DNA, 14 bp, synthetic construct
  source 1..14: mol_type = other DNA
tctcatcccacatc

SEQ ID NO: 2310 - DNA, 14 bp, synthetic construct
  source 1..14: mol_type = other DNA
tagtgaggcgattg

SEQ ID NO: 2311 - DNA, 14 bp, synthetic construct
  source 1..14: mol_type = other DNA
ctaagggctgcatt

SEQ ID NO: 2312 - DNA, 14 bp, synthetic construct
  source 1..14: mol_type = other DNA
aaaatcactgttac

SEQ ID NO: 2313 - DNA, 14 bp, synthetic construct
  source 1..14: mol_type = other DNA
ggtttggtaacgga

SEQ ID NO: 2314 - DNA, 14 bp, synthetic construct
  source 1..14: mol_type = other DNA
cagttatataagcg

SEQ ID NO: 2315 - DNA, 14 bp, synthetic construct
  source 1..14: mol_type = other DNA
agcataatcatgct

SEQ ID NO: 2316 - DNA, 14 bp, synthetic construct
  source 1..14: mol_type = other DNA
agtctctaagatcc

SEQ ID NO: 2317 - DNA, 14 bp, synthetic construct
  source 1..14: mol_type = other DNA
tgtaactccggcta

SEQ ID NO: 2318 - DNA, 14 bp, synthetic construct
  source 1..14: mol_type = other DNA
gactcgttagccat

SEQ ID NO: 2319 - DNA, 14 bp, synthetic construct
  source 1..14: mol_type = other DNA
ggtcggttgcccta

SEQ ID NO: 2320 - DNA, 14 bp, synthetic construct
  source 1..14: mol_type = other DNA
gtggcagtgattac

SEQ ID NO: 2321 - DNA, 14 bp, synthetic construct
  source 1..14: mol_type = other DNA
gtagccgtcatcgt

SEQ ID NO: 2322 - DNA, 14 bp, synthetic construct
  source 1..14: mol_type = other DNA
tagatcgctaactg

SEQ ID NO: 2323 - DNA, 14 bp, synthetic construct
  source 1..14: mol_type = other DNA
tcccaacatatagt

SEQ ID NO: 2324 - DNA, 14 bp, synthetic construct
  source 1..14: mol_type = other DNA
tcctcgtactgtgg

SEQ ID NO: 2325 - DNA, 14 bp, synthetic construct
  source 1..14: mol_type = other DNA
gttggtcagggtta

SEQ ID NO: 2326 - DNA, 14 bp, synthetic construct
  source 1..14: mol_type = other DNA
ggttggacctttaa

SEQ ID NO: 2327 - DNA, 14 bp, synthetic construct
  source 1..14: mol_type = other DNA
cctcctcctgctta

SEQ ID NO: 2328 - DNA, 14 bp, synthetic construct
  source 1..14: mol_type = other DNA
tttccgactagtaa

SEQ ID NO: 2329 - DNA, 14 bp, synthetic construct
  source 1..14: mol_type = other DNA
acgaattacgtatt

SEQ ID NO: 2330 - DNA, 14 bp, synthetic construct
  source 1..14: mol_type = other DNA
gaacatcgtattta

SEQ ID NO: 2331 - DNA, 14 bp, synthetic construct
  source 1..14: mol_type = other DNA
gtctcttacaactc

SEQ ID NO: 2332 - DNA, 14 bp, synthetic construct
  source 1..14: mol_type = other DNA
ttctaatcacgctg

SEQ ID NO: 2333 - DNA, 14 bp, synthetic construct
  source 1..14: mol_type = other DNA
ataatcagtactgt

SEQ ID NO: 2334 - DNA, 14 bp, synthetic construct
  source 1..14: mol_type = other DNA
gggctaaacttttc

SEQ ID NO: 2335 - DNA, 14 bp, synthetic construct
  source 1..14: mol_type = other DNA
atacactgagattt

SEQ ID NO: 2336 - DNA, 14 bp, synthetic construct
  source 1..14: mol_type = other DNA
tgtctaagtcgtgg

SEQ ID NO: 2337 - DNA, 14 bp, synthetic construct
  source 1..14: mol_type = other DNA
tttaactcacagtc

SEQ ID NO: 2338 - DNA, 14 bp, synthetic construct
  source 1..14: mol_type = other DNA
atgtcttcaagcat

SEQ ID NO: 2339 - DNA, 14 bp, synthetic construct
  source 1..14: mol_type = other DNA
ttcttgcaaagctc

SEQ ID NO: 2340 - DNA, 14 bp, synthetic construct
  source 1..14: mol_type = other DNA
gtagtatataggtc

SEQ ID NO: 2341 - DNA, 14 bp, synthetic construct
  source 1..14: mol_type = other DNA
aaatttctctacgg

SEQ ID NO: 2342 - DNA, 14 bp, synthetic construct
  source 1..14: mol_type = other DNA
gtctccgctagtct

SEQ ID NO: 2343 - DNA, 14 bp, synthetic construct
  source 1..14: mol_type = other DNA
tttcatccacgcgt

SEQ ID NO: 2344 - DNA, 14 bp, synthetic construct
  source 1..14: mol_type = other DNA
gctcgaatctatct

SEQ ID NO: 2345 - DNA, 14 bp, synthetic construct
  source 1..14: mol_type = other DNA
catgttcccgctat

SEQ ID NO: 2346 - DNA, 14 bp, synthetic construct
  source 1..14: mol_type = other DNA
gtcttggacactct

SEQ ID NO: 2347 - DNA, 14 bp, synthetic construct
  source 1..14: mol_type = other DNA
gtgaatcggtttca

SEQ ID NO: 2348 - DNA, 14 bp, synthetic construct
  source 1..14: mol_type = other DNA
tacatgctttcgcc

SEQ ID NO: 2349 - DNA, 14 bp, synthetic construct
  source 1..14: mol_type = other DNA
ggtggacttatcct

SEQ ID NO: 2350 - DNA, 14 bp, synthetic construct
  source 1..14: mol_type = other DNA
cgcttggagttact

SEQ ID NO: 2351 - DNA, 14 bp, synthetic construct
  source 1..14: mol_type = other DNA
tctgggtaccttgg

SEQ ID NO: 2352 - DNA, 14 bp, synthetic construct
  source 1..14: mol_type = other DNA
cggagtattgattc

SEQ ID NO: 2353 - DNA, 14 bp, synthetic construct
  source 1..14: mol_type = other DNA
cagttgaatgtgat

SEQ ID NO: 2354 - DNA, 14 bp, synthetic construct
  source 1..14: mol_type = other DNA
gatataggcttgtc

SEQ ID NO: 2355 - DNA, 14 bp, synthetic construct
  source 1..14: mol_type = other DNA
tacatctccattag

SEQ ID NO: 2356 - DNA, 14 bp, synthetic construct
  source 1..14: mol_type = other DNA
tgcgcaaatttcct

SEQ ID NO: 2357 - DNA, 14 bp, synthetic construct
  source 1..14: mol_type = other DNA
acgtagtcatatat

SEQ ID NO: 2358 - DNA, 14 bp, synthetic construct
  source 1..14: mol_type = other DNA
gaaatacgtgttct

SEQ ID NO: 2359 - DNA, 14 bp, synthetic construct
  source 1..14: mol_type = other DNA
ctcaggtaggtttg

SEQ ID NO: 2360 - DNA, 14 bp, synthetic construct
  source 1..14: mol_type = other DNA
gatcgttgcgatgt

SEQ ID NO: 2361 - DNA, 14 bp, synthetic construct
  source 1..14: mol_type = other DNA
ggagtttgtataga

SEQ ID NO: 2362 - DNA, 14 bp, synthetic construct
  source 1..14: mol_type = other DNA
gattcaacttctag

SEQ ID NO: 2363 - DNA, 14 bp, synthetic construct
  source 1..14: mol_type = other DNA
tcatgtatatctga

SEQ ID NO: 2364 - DNA, 14 bp, synthetic construct
  source 1..14: mol_type = other DNA
aagctgtcatttta

SEQ ID NO: 2365 - DNA, 14 bp, synthetic construct
  source 1..14: mol_type = other DNA
ttccttctccagta

SEQ ID NO: 2366 - DNA, 14 bp, synthetic construct
  source 1..14: mol_type = other DNA
atatcacgatttta

SEQ ID NO: 2367 - DNA, 14 bp, synthetic construct
  source 1..14: mol_type = other DNA
gatctcattttaag

SEQ ID NO: 2368 - DNA, 14 bp, synthetic construct
  source 1..14: mol_type = other DNA
atctatgaattgat

SEQ ID NO: 2369 - DNA, 14 bp, synthetic construct
  source 1..14: mol_type = other DNA
tcttgtgtcgcata

SEQ ID NO: 2370 - DNA, 14 bp, synthetic construct
  source 1..14: mol_type = other DNA
cgtgttttcagtag

SEQ ID NO: 2371 - DNA, 14 bp, synthetic construct
  source 1..14: mol_type = other DNA
cgtttcactcatct

SEQ ID NO: 2372 - DNA, 14 bp, synthetic construct
  source 1..14: mol_type = other DNA
ttcatccactcctt

SEQ ID NO: 2373 - DNA, 14 bp, synthetic construct
  source 1..14: mol_type = other DNA
ttcttatggtcagc

SEQ ID NO: 2374 - DNA, 14 bp, synthetic construct
  source 1..14: mol_type = other DNA
tctatgcgatttaa

SEQ ID NO: 2375 - DNA, 14 bp, synthetic construct
  source 1..14: mol_type = other DNA
ttctcatatcccgt

SEQ ID NO: 2376 - DNA, 14 bp, synthetic construct
  source 1..14: mol_type = other DNA
tacgtctattataa

SEQ ID NO: 2377 - DNA, 14 bp, synthetic construct
  source 1..14: mol_type = other DNA
tgactctctcgttg

SEQ ID NO: 2378 - DNA, 14 bp, synthetic construct
  source 1..14: mol_type = other DNA
gtttaacgtatata

SEQ ID NO: 2379 - DNA, 14 bp, synthetic construct
  source 1..14: mol_type = other DNA
ttgatatctcgtca

SEQ ID NO: 2380 - DNA, 14 bp, synthetic construct
  source 1..14: mol_type = other DNA
taatagtctcctct

SEQ ID NO: 2381 - DNA, 14 bp, synthetic construct
  source 1..14: mol_type = other DNA
tgaagtgttcatgt

SEQ ID NO: 2382 - DNA, 14 bp, synthetic construct
  source 1..14: mol_type = other DNA
taatttcgtcatag

SEQ ID NO: 2383 - DNA, 14 bp, synthetic construct
  source 1..14: mol_type = other DNA
tattaagctttgga

SEQ ID NO: 2384 - DNA, 14 bp, synthetic construct
  source 1..14: mol_type = other DNA
cgtgttgatcattc

SEQ ID NO: 2385 - DNA, 14 bp, synthetic construct
  source 1..14: mol_type = other DNA
acttagttgttagc

SEQ ID NO: 2386 - DNA, 14 bp, synthetic construct
  source 1..14: mol_type = other DNA
ttagtctgggagtt

SEQ ID NO: 2387 - DNA, 14 bp, synthetic construct
  source 1..14: mol_type = other DNA
aatattctgttgcg

SEQ ID NO: 2388 - DNA, 14 bp, synthetic construct
  source 1..14: mol_type = other DNA
gtcgtcatgttgct

SEQ ID NO: 2389 - DNA, 14 bp, synthetic construct
  source 1..14: mol_type = other DNA
tatctagtccttgg

SEQ ID NO: 2390 - DNA, 14 bp, synthetic construct
  source 1..14: mol_type = other DNA
agatcattgttgta

SEQ ID NO: 2391 - DNA, 14 bp, synthetic construct
  source 1..14: mol_type = other DNA
attttccctcgatc

SEQ ID NO: 2392 - DNA, 14 bp, synthetic construct
  source 1..14: mol_type = other DNA
agatttccagattt

SEQ ID NO: 2393 - DNA, 14 bp, synthetic construct
  source 1..14: mol_type = other DNA
tcattatactgata

SEQ ID NO: 2394 - DNA, 14 bp, synthetic construct
  source 1..14: mol_type = other DNA
tcctctttggggat

SEQ ID NO: 2395 - DNA, 14 bp, synthetic construct
  source 1..14: mol_type = other DNA
gacattatctagtt

SEQ ID NO: 2396 - DNA, 14 bp, synthetic construct
  source 1..14: mol_type = other DNA
gttccattgaattg

SEQ ID NO: 2397 - DNA, 14 bp, synthetic construct
  source 1..14: mol_type = other DNA
gtgatattcacttc

SEQ ID NO: 2398 - DNA, 14 bp, synthetic construct
  source 1..14: mol_type = other DNA
gcttatgcttcctg

SEQ ID NO: 2399 - DNA, 14 bp, synthetic construct
  source 1..14: mol_type = other DNA
agttcgctttggtg

SEQ ID NO: 2400 - DNA, 14 bp, synthetic construct
  source 1..14: mol_type = other DNA
gttgtataaccctt

SEQ ID NO: 2401 - DNA, 14 bp, synthetic construct
  source 1..14: mol_type = other DNA
gatttctttccagc

SEQ ID NO: 2402 - DNA, 14 bp, synthetic construct
  source 1..14: mol_type = other DNA
cagcttcatcttct

SEQ ID NO: 2403 - DNA, 14 bp, synthetic construct
  source 1..14: mol_type = other DNA
ttcgtattgagcct

SEQ ID NO: 2404 - DNA, 14 bp, synthetic construct
  source 1..14: mol_type = other DNA
taggtgtttagtga

SEQ ID NO: 2405 - DNA, 14 bp, synthetic construct
  source 1..14: mol_type = other DNA
cccatagcttttta

SEQ ID NO: 2406 - DNA, 14 bp, synthetic construct
  source 1..14: mol_type = other DNA
aaggggaggcccgg

SEQ ID NO: 2407 - DNA, 14 bp, synthetic construct
  source 1..14: mol_type = other DNA
gagcaagggcaccg

SEQ ID NO: 2408 - DNA, 14 bp, synthetic construct
  source 1..14: mol_type = other DNA
ggccgacacagcgc

SEQ ID NO: 2409 - DNA, 14 bp, synthetic construct
  source 1..14: mol_type = other DNA
caacacgcggaagc

SEQ ID NO: 2410 - DNA, 14 bp, synthetic construct
  source 1..14: mol_type = other DNA
gaaacggccgcgga

SEQ ID NO: 2411 - DNA, 14 bp, synthetic construct
  source 1..14: mol_type = other DNA
caccagaggacgga

SEQ ID NO: 2412 - DNA, 14 bp, synthetic construct
  source 1..14: mol_type = other DNA
aacaacggcgcccg

SEQ ID NO: 2413 - DNA, 14 bp, synthetic construct
  source 1..14: mol_type = other DNA
acacccacaccccg

SEQ ID NO: 2414 - DNA, 14 bp, synthetic construct
  source 1..14: mol_type = other DNA
cacgaggccaaaac

SEQ ID NO: 2415 - DNA, 14 bp, synthetic construct
  source 1..14: mol_type = other DNA
aaaaggcacccaac

SEQ ID NO: 2416 - DNA, 14 bp, synthetic construct
  source 1..14: mol_type = other DNA
caacaccgagccga

SEQ ID NO: 2417 - DNA, 14 bp, synthetic construct
  source 1..14: mol_type = other DNA
ggcaagacaagaga

SEQ ID NO: 2418 - DNA, 14 bp, synthetic construct
  source 1..14: mol_type = other DNA
acgacgacccagcg

SEQ ID NO: 2419 - DNA, 14 bp, synthetic construct
  source 1..14: mol_type = other DNA
cacaccgaggccca

SEQ ID NO: 2420 - DNA, 14 bp, synthetic construct
  source 1..14: mol_type = other DNA
aaaaggacgagcaa

SEQ ID NO: 2421 - DNA, 14 bp, synthetic construct
  source 1..14: mol_type = other DNA
aagcaaaacgaaag

SEQ ID NO: 2422 - DNA, 14 bp, synthetic construct
  source 1..14: mol_type = other DNA
agcacgccagacga

SEQ ID NO: 2423 - DNA, 14 bp, synthetic construct
  source 1..14: mol_type = other DNA
gaagcacgcagcac

SEQ ID NO: 2424 - DNA, 14 bp, synthetic construct
  source 1..14: mol_type = other DNA
ccgcacagcacgcc

SEQ ID NO: 2425 - DNA, 14 bp, synthetic construct
  source 1..14: mol_type = other DNA
acgacgacacgagc

SEQ ID NO: 2426 - DNA, 14 bp, synthetic construct
  source 1..14: mol_type = other DNA
cggggagcagaaga

SEQ ID NO: 2427 - DNA, 14 bp, synthetic construct
  source 1..14: mol_type = other DNA
cccaaagacagcgc

SEQ ID NO: 2428 - DNA, 14 bp, synthetic construct
  source 1..14: mol_type = other DNA
ccggagcaccaccg

SEQ ID NO: 2429 - DNA, 14 bp, synthetic construct
  source 1..14: mol_type = other DNA
gcccagcaaaagag

SEQ ID NO: 2430 - DNA, 14 bp, synthetic construct
  source 1..14: mol_type = other DNA
agcagacgcgacgc

SEQ ID NO: 2431 - DNA, 14 bp, synthetic construct
  source 1..14: mol_type = other DNA
agcgaaagacacag

SEQ ID NO: 2432 - DNA, 14 bp, synthetic construct
  source 1..14: mol_type = other DNA
acaggaggcggacc

SEQ ID NO: 2433 - DNA, 14 bp, synthetic construct
  source 1..14: mol_type = other DNA
agcacgcaagggcg

SEQ ID NO: 2434 - DNA, 14 bp, synthetic construct
  source 1..14: mol_type = other DNA
gaaagcccgacgca

SEQ ID NO: 2435 - DNA, 14 bp, synthetic construct
  source 1..14: mol_type = other DNA
gaaacgcagaccgg

SEQ ID NO: 2436 - DNA, 14 bp, synthetic construct
  source 1..14: mol_type = other DNA
caagccacgcagaa

SEQ ID NO: 2437 - DNA, 14 bp, synthetic construct
  source 1..14: mol_type = other DNA
gcgacccggagaaa

SEQ ID NO: 2438 - DNA, 14 bp, synthetic construct
  source 1..14: mol_type = other DNA
gcgaaaggcgcgga

SEQ ID NO: 2439 - DNA, 14 bp, synthetic construct
  source 1..14: mol_type = other DNA
acacacaacagagc

SEQ ID NO: 2440 - DNA, 14 bp, synthetic construct
  source 1..14: mol_type = other DNA
cccagaacaacgcg

SEQ ID NO: 2441 - DNA, 14 bp, synthetic construct
  source 1..14: mol_type = other DNA
aaaacgggaacgcc

SEQ ID NO: 2442 - DNA, 14 bp, synthetic construct
  source 1..14: mol_type = other DNA
gagaccaacggaaa

SEQ ID NO: 2443 - DNA, 14 bp, synthetic construct
  source 1..14: mol_type = other DNA
gagagccacgagca

SEQ ID NO: 2444 - DNA, 14 bp, synthetic construct
  source 1..14: mol_type = other DNA
cggaaacgaggaag

SEQ ID NO: 2445 - DNA, 14 bp, synthetic construct
  source 1..14: mol_type = other DNA
caagagagggcaag

SEQ ID NO: 2446 - DNA, 14 bp, synthetic construct
  source 1..14: mol_type = other DNA
cgacgcgaaagcgg

SEQ ID NO: 2447 - DNA, 14 bp, synthetic construct
  source 1..14: mol_type = other DNA
cacggcacgcgaca

SEQ ID NO: 2448 - DNA, 14 bp, synthetic construct
  source 1..14: mol_type = other DNA
cagagccgcagcaa

SEQ ID NO: 2449 - DNA, 14 bp, synthetic construct
  source 1..14: mol_type = other DNA
accctgcgggacac

SEQ ID NO: 2450 - DNA, 14 bp, synthetic construct
  source 1..14: mol_type = other DNA
gaggcaacgcaata

SEQ ID NO: 2451 - DNA, 14 bp, synthetic construct
  source 1..14: mol_type = other DNA
agcgtaagcccaac

SEQ ID NO: 2452 - DNA, 14 bp, synthetic construct
  source 1..14: mol_type = other DNA
gagaccctagacga

SEQ ID NO: 2453 - DNA, 14 bp, synthetic construct
  source 1..14: mol_type = other DNA
gccaacccacacct

SEQ ID NO: 2454 - DNA, 14 bp, synthetic construct
  source 1..14: mol_type = other DNA
cgaaccgtcaacag

SEQ ID NO: 2455 - DNA, 14 bp, synthetic construct
  source 1..14: mol_type = other DNA
aacgctggcagagg

SEQ ID NO: 2456 - DNA, 14 bp, synthetic construct
  source 1..14: mol_type = other DNA
cacagcggtcagaa

SEQ ID NO: 2457 - DNA, 14 bp, synthetic construct
  source 1..14: mol_type = other DNA
cactaagcggcgac

SEQ ID NO: 2458 - DNA, 14 bp, synthetic construct
  source 1..14: mol_type = other DNA
gcccgtaccgcaca

SEQ ID NO: 2459 - DNA, 14 bp, synthetic construct
  source 1..14: mol_type = other DNA
agcccgtgacaaag

SEQ ID NO: 2460 - DNA, 14 bp, synthetic construct
  source 1..14: mol_type = other DNA
ctgaaaagagacga

SEQ ID NO: 2461 - DNA, 14 bp, synthetic construct
  source 1..14: mol_type = other DNA
gggaaccagctgcc

SEQ ID NO: 2462 - DNA, 14 bp, synthetic construct
  source 1..14: mol_type = other DNA
cacctcaccgcgca

SEQ ID NO: 2463 - DNA, 14 bp, synthetic construct
  source 1..14: mol_type = other DNA
gcccctccgagaac

SEQ ID NO: 2464 - DNA, 14 bp, synthetic construct
  source 1..14: mol_type = other DNA
ccgaaagggcataa

SEQ ID NO: 2465 - DNA, 14 bp, synthetic construct
  source 1..14: mol_type = other DNA
gaaatccgacaccg

SEQ ID NO: 2466 - DNA, 14 bp, synthetic construct
  source 1..14: mol_type = other DNA
tggaagacgggagc

SEQ ID NO: 2467 - DNA, 14 bp, synthetic construct
  source 1..14: mol_type = other DNA
tgggaccacccaaa

SEQ ID NO: 2468 - DNA, 14 bp, synthetic construct
  source 1..14: mol_type = other DNA
cgacaatagccaaa

SEQ ID NO: 2469 - DNA, 14 bp, synthetic construct
  source 1..14: mol_type = other DNA
gcatggaaggcgcg

SEQ ID NO: 2470 - DNA, 14 bp, synthetic construct
  source 1..14: mol_type = other DNA
agagacggatggac

SEQ ID NO: 2471 - DNA, 14 bp, synthetic construct
  source 1..14: mol_type = other DNA
cataaggcggagcg

SEQ ID NO: 2472 - DNA, 14 bp, synthetic construct
  source 1..14: mol_type = other DNA
agaggccgtgggga

SEQ ID NO: 2473 - DNA, 14 bp, synthetic construct
  source 1..14: mol_type = other DNA
tgggaccgggacgc

SEQ ID NO: 2474 - DNA, 14 bp, synthetic construct
  source 1..14: mol_type = other DNA
caaaaggcctccca

SEQ ID NO: 2475 - DNA, 14 bp, synthetic construct
  source 1..14: mol_type = other DNA
tgggacacaacgga

SEQ ID NO: 2476 - DNA, 14 bp, synthetic construct
  source 1..14: mol_type = other DNA
aacacggtcccacc

SEQ ID NO: 2477 - DNA, 14 bp, synthetic construct
  source 1..14: mol_type = other DNA
gacgctcaacaaag

SEQ ID NO: 2478 - DNA, 14 bp, synthetic construct
  source 1..14: mol_type = other DNA
cacatgggagccac

SEQ ID NO: 2479 - DNA, 14 bp, synthetic construct
  source 1..14: mol_type = other DNA
cgagaaacatacaa

SEQ ID NO: 2480 - DNA, 14 bp, synthetic construct
  source 1..14: mol_type = other DNA
agacacgtaccacc

SEQ ID NO: 2481 - DNA, 14 bp, synthetic construct
  source 1..14: mol_type = other DNA
aagcgcgaacctca

SEQ ID NO: 2482 - DNA, 14 bp, synthetic construct
  source 1..14: mol_type = other DNA
agcccagcctgcaa

SEQ ID NO: 2483 - DNA, 14 bp, synthetic construct
  source 1..14: mol_type = other DNA
gtggcaccaggaac

SEQ ID NO: 2484 - DNA, 14 bp, synthetic construct
  source 1..14: mol_type = other DNA
agcctaggagcggg

SEQ ID NO: 2485 - DNA, 14 bp, synthetic construct
  source 1..14: mol_type = other DNA
cagacgcccatccc

SEQ ID NO: 2486 - DNA, 14 bp, synthetic construct
  source 1..14: mol_type = other DNA
agaaagtcacaacg

SEQ ID NO: 2487 - DNA, 14 bp, synthetic construct
  source 1..14: mol_type = other DNA
aggcagtcccgaga

SEQ ID NO: 2488 - DNA, 14 bp, synthetic construct
  source 1..14: mol_type = other DNA
cggtcacgacacca

SEQ ID NO: 2489 - DNA, 14 bp, synthetic construct
  source 1..14: mol_type = other DNA
gtaaccacaacagc

SEQ ID NO: 2490 - DNA, 14 bp, synthetic construct
  source 1..14: mol_type = other DNA
aactggacccacag

SEQ ID NO: 2491 - DNA, 14 bp, synthetic construct
  source 1..14: mol_type = other DNA
ctcaaagcgcgaaa

SEQ ID NO: 2492 - DNA, 14 bp, synthetic construct
  source 1..14: mol_type = other DNA
acgagagacaaatc

SEQ ID NO: 2493 - DNA, 14 bp, synthetic construct
  source 1..14: mol_type = other DNA
ggtcccccaagaag

SEQ ID NO: 2494 - DNA, 14 bp, synthetic construct
  source 1..14: mol_type = other DNA
gtaggaaagacagg

SEQ ID NO: 2495 - DNA, 14 bp, synthetic construct
  source 1..14: mol_type = other DNA
gtgacggcaagccc

SEQ ID NO: 2496 - DNA, 14 bp, synthetic construct
  source 1..14: mol_type = other DNA
aaccgagccccaat

SEQ ID NO: 2497 - DNA, 14 bp, synthetic construct
  source 1..14: mol_type = other DNA
gacggaccgaggta

SEQ ID NO: 2498 - DNA, 14 bp, synthetic construct
  source 1..14: mol_type = other DNA
aaaaggatgacagc

SEQ ID NO: 2499 - DNA, 14 bp, synthetic construct
  source 1..14: mol_type = other DNA
agaagatgcacagc

SEQ ID NO: 2500 - DNA, 14 bp, synthetic construct
  source 1..14: mol_type = other DNA
cgagaagcgccgat

SEQ ID NO: 2501 - DNA, 14 bp, synthetic construct
  source 1..14: mol_type = other DNA
gcacgcactgccga

SEQ ID NO: 2502 - DNA, 14 bp, synthetic construct
  source 1..14: mol_type = other DNA
atgccccaaacccg

SEQ ID NO: 2503 - DNA, 14 bp, synthetic construct
  source 1..14: mol_type = other DNA
aaaacgccacgata

SEQ ID NO: 2504 - DNA, 14 bp, synthetic construct
  source 1..14: mol_type = other DNA
ccggataaggggcc

SEQ ID NO: 2505 - DNA, 14 bp, synthetic construct
  source 1..14: mol_type = other DNA
gacaagtcggacgc

SEQ ID NO: 2506 - DNA, 14 bp, synthetic construct
  source 1..14: mol_type = other DNA
ataaacgcaccagg

SEQ ID NO: 2507 - DNA, 14 bp, synthetic construct
  source 1..14: mol_type = other DNA
aagtcagaccgccc

SEQ ID NO: 2508 - DNA, 14 bp, synthetic construct
  source 1..14: mol_type = other DNA
ggcgtgcaacggag

SEQ ID NO: 2509 - DNA, 14 bp, synthetic construct
  source 1..14: mol_type = other DNA
gagagaccccaatc

SEQ ID NO: 2510 - DNA, 14 bp, synthetic construct
  source 1..14: mol_type = other DNA
cccagcctcagggc

SEQ ID NO: 2511 - DNA, 14 bp, synthetic construct
  source 1..14: mol_type = other DNA
gggaaatccagcag

SEQ ID NO: 2512 - DNA, 14 bp, synthetic construct
  source 1..14: mol_type = other DNA
aaacacaggcagct

SEQ ID NO: 2513 - DNA, 14 bp, synthetic construct
  source 1..14: mol_type = other DNA
ccacggtaccaagg

SEQ ID NO: 2514 - DNA, 14 bp, synthetic construct
  source 1..14: mol_type = other DNA
cagtgcgggacgcg

SEQ ID NO: 2515 - DNA, 14 bp, synthetic construct
  source 1..14: mol_type = other DNA
cgagcgtaaggcga

SEQ ID NO: 2516 - DNA, 14 bp, synthetic construct
  source 1..14: mol_type = other DNA
ggaaccctaaggga

SEQ ID NO: 2517 - DNA, 14 bp, synthetic construct
  source 1..14: mol_type = other DNA
gggatgaacaagag

SEQ ID NO: 2518 - DNA, 14 bp, synthetic construct
  source 1..14: mol_type = other DNA
gcggtgcgcaaggg

SEQ ID NO: 2519 - DNA, 14 bp, synthetic construct
  source 1..14: mol_type = other DNA
caaaccaactggcg

SEQ ID NO: 2520 - DNA, 14 bp, synthetic construct
  source 1..14: mol_type = other DNA
gccgaaggaacgtg

SEQ ID NO: 2521 - DNA, 14 bp, synthetic construct
  source 1..14: mol_type = other DNA
gcacgaagacccta

SEQ ID NO: 2522 - DNA, 14 bp, synthetic construct
  source 1..14: mol_type = other DNA
gagcctagcgccgg

SEQ ID NO: 2523 - DNA, 14 bp, synthetic construct
  source 1..14: mol_type = other DNA
tacaagcacaccgc

SEQ ID NO: 2524 - DNA, 14 bp, synthetic construct
  source 1..14: mol_type = other DNA
gccgcaaataccac

SEQ ID NO: 2525 - DNA, 14 bp, synthetic construct
  source 1..14: mol_type = other DNA
cactcacagccagc

SEQ ID NO: 2526 - DNA, 14 bp, synthetic construct
  source 1..14: mol_type = other DNA
cagaaccctcgccg

SEQ ID NO: 2527 - DNA, 14 bp, synthetic construct
  source 1..14: mol_type = other DNA
aaccacccctagac

SEQ ID NO: 2528 - DNA, 14 bp, synthetic construct
  source 1..14: mol_type = other DNA
gatcgccaaaccgg

SEQ ID NO: 2529 - DNA, 14 bp, synthetic construct
  source 1..14: mol_type = other DNA
taaccagaaacacc

SEQ ID NO: 2530 - DNA, 14 bp, synthetic construct
  source 1..14: mol_type = other DNA
cacctaggccggac

SEQ ID NO: 2531 - DNA, 14 bp, synthetic construct
  source 1..14: mol_type = other DNA
acgcaaatgcagcc

SEQ ID NO: 2532 - DNA, 14 bp, synthetic construct
  source 1..14: mol_type = other DNA
aagcggaccgctga

SEQ ID NO: 2533 - DNA, 14 bp, synthetic construct
  source 1..14: mol_type = other DNA
tgccaagggccggc

SEQ ID NO: 2534 - DNA, 14 bp, synthetic construct
  source 1..14: mol_type = other DNA
cccgagtagcgcgg

SEQ ID NO: 2535 - DNA, 14 bp, synthetic construct
  source 1..14: mol_type = other DNA
gtcccagacgcccc

SEQ ID NO: 2536 - DNA, 14 bp, synthetic construct
  source 1..14: mol_type = other DNA
aaacgcgcgcggtg

SEQ ID NO: 2537 - DNA, 14 bp, synthetic construct
  source 1..14: mol_type = other DNA
gggaagcaggcatc

SEQ ID NO: 2538 - DNA, 14 bp, synthetic construct
  source 1..14: mol_type = other DNA
acgaaagcatgcac

SEQ ID NO: 2539 - DNA, 14 bp, synthetic construct
  source 1..14: mol_type = other DNA
acgcagtggaagag

SEQ ID NO: 2540 - DNA, 14 bp, synthetic construct
  source 1..14: mol_type = other DNA
aatacgaaaacacg

SEQ ID NO: 2541 - DNA, 14 bp, synthetic construct
  source 1..14: mol_type = other DNA
cgcggagagagcct

SEQ ID NO: 2542 - DNA, 14 bp, synthetic construct
  source 1..14: mol_type = other DNA
cataagcgcacacc

SEQ ID NO: 2543 - DNA, 14 bp, synthetic construct
  source 1..14: mol_type = other DNA
ggcaaaagtaagca

SEQ ID NO: 2544 - DNA, 14 bp, synthetic construct
  source 1..14: mol_type = other DNA
cagagtggcgcccc

SEQ ID NO: 2545 - DNA, 14 bp, synthetic construct
  source 1..14: mol_type = other DNA
gcaccctcagaccc

SEQ ID NO: 2546 - DNA, 14 bp, synthetic construct
  source 1..14: mol_type = other DNA
gaaaaccgcgacat

SEQ ID NO: 2547 - DNA, 14 bp, synthetic construct
  source 1..14: mol_type = other DNA
aaaagtggcgcaag

SEQ ID NO: 2548 - DNA, 14 bp, synthetic construct
  source 1..14: mol_type = other DNA
cacaaagagccgtg

SEQ ID NO: 2549 - DNA, 14 bp, synthetic construct
  source 1..14: mol_type = other DNA
aacctacaagcgca

SEQ ID NO: 2550 - DNA, 14 bp, synthetic construct
  source 1..14: mol_type = other DNA
cagataagcccgcc

SEQ ID NO: 2551 - DNA, 14 bp, synthetic construct
  source 1..14: mol_type = other DNA
caaaaaccacatcg

SEQ ID NO: 2552 - DNA, 14 bp, synthetic construct
  source 1..14: mol_type = other DNA
caaccccaccccct

SEQ ID NO: 2553 - DNA, 14 bp, synthetic construct
  source 1..14: mol_type = other DNA
ccgcgacctaacac

SEQ ID NO: 2554 - DNA, 14 bp, synthetic construct
  source 1..14: mol_type = other DNA
agcgagaaatcgac

SEQ ID NO: 2555 - DNA, 14 bp, synthetic construct
  source 1..14: mol_type = other DNA
acaagacaataacg

SEQ ID NO: 2556 - DNA, 14 bp, synthetic construct
  source 1..14: mol_type = other DNA
gactacacgaccga

SEQ ID NO: 2557 - DNA, 14 bp, synthetic construct
  source 1..14: mol_type = other DNA
aacaacgcgactaa

SEQ ID NO: 2558 - DNA, 14 bp, synthetic construct
  source 1..14: mol_type = other DNA
cgcgtagggcagag

SEQ ID NO: 2559 - DNA, 14 bp, synthetic construct
  source 1..14: mol_type = other DNA
aaacgggaatgaag

SEQ ID NO: 2560 - DNA, 14 bp, synthetic construct
  source 1..14: mol_type = other DNA
ggccagcaacgtgc

SEQ ID NO: 2561 - DNA, 14 bp, synthetic construct
  source 1..14: mol_type = other DNA
gaaccgaagggaat

SEQ ID NO: 2562 - DNA, 14 bp, synthetic construct
  source 1..14: mol_type = other DNA
ataaaaagcaaccc

SEQ ID NO: 2563 - DNA, 14 bp, synthetic construct
  source 1..14: mol_type = other DNA
cggagcacgataac

SEQ ID NO: 2564 - DNA, 14 bp, synthetic construct
  source 1..14: mol_type = other DNA
caacagtgcccaga

SEQ ID NO: 2565 - DNA, 14 bp, synthetic construct
  source 1..14: mol_type = other DNA
ccaggccacgtcgg

SEQ ID NO: 2566 - DNA, 14 bp, synthetic construct
  source 1..14: mol_type = other DNA
cgcgtgcccagagg

SEQ ID NO: 2567 - DNA, 14 bp, synthetic construct
  source 1..14: mol_type = other DNA
caccgcacacatgg

SEQ ID NO: 2568 - DNA, 14 bp, synthetic construct
  source 1..14: mol_type = other DNA
gaggtcaagcaggg

SEQ ID NO: 2569 - DNA, 14 bp, synthetic construct
  source 1..14: mol_type = other DNA
accccgactgccgg

SEQ ID NO: 2570 - DNA, 14 bp, synthetic construct
  source 1..14: mol_type = other DNA
cacctgcacacgac

SEQ ID NO: 2571 - DNA, 14 bp, synthetic construct
  source 1..14: mol_type = other DNA
gagaaaaagaaatc

SEQ ID NO: 2572 - DNA, 14 bp, synthetic construct
  source 1..14: mol_type = other DNA
aagcgcaacccgtg

SEQ ID NO: 2573 - DNA, 14 bp, synthetic construct
  source 1..14: mol_type = other DNA
aagagatagacgac

SEQ ID NO: 2574 - DNA, 14 bp, synthetic construct
  source 1..14: mol_type = other DNA
gcatcgaaccgcga

SEQ ID NO: 2575 - DNA, 14 bp, synthetic construct
  source 1..14: mol_type = other DNA
catggacaaagacg

SEQ ID NO: 2576 - DNA, 14 bp, synthetic construct
  source 1..14: mol_type = other DNA
cgaatagaaacgga

SEQ ID NO: 2577 - DNA, 14 bp, synthetic construct
  source 1..14: mol_type = other DNA
tcagaaagggcacc

SEQ ID NO: 2578 - DNA, 14 bp, synthetic construct
  source 1..14: mol_type = other DNA
gtgtgcacccgggc

SEQ ID NO: 2579 - DNA, 14 bp, synthetic construct
  source 1..14: mol_type = other DNA
cgctcgcgagatgg

SEQ ID NO: 2580 - DNA, 14 bp, synthetic construct
  source 1..14: mol_type = other DNA
gagaagttacaaag

SEQ ID NO: 2581 - DNA, 14 bp, synthetic construct
  source 1..14: mol_type = other DNA
gaagtcacaagcgt

SEQ ID NO: 2582 - DNA, 14 bp, synthetic construct
  source 1..14: mol_type = other DNA
gcatagagcaggtc

SEQ ID NO: 2583 - DNA, 14 bp, synthetic construct
  source 1..14: mol_type = other DNA
agttcgcgggccca

SEQ ID NO: 2584 - DNA, 14 bp, synthetic construct
  source 1..14: mol_type = other DNA
agtcacaaactcaa

SEQ ID NO: 2585 - DNA, 14 bp, synthetic construct
  source 1..14: mol_type = other DNA
gaggagcgtacgtc

SEQ ID NO: 2586 - DNA, 14 bp, synthetic construct
  source 1..14: mol_type = other DNA
tcggagcggctggc

SEQ ID NO: 2587 - DNA, 14 bp, synthetic construct
  source 1..14: mol_type = other DNA
cgcgatacgcctga

SEQ ID NO: 2588 - DNA, 14 bp, synthetic construct
  source 1..14: mol_type = other DNA
caacgggctagtca

SEQ ID NO: 2589 - DNA, 14 bp, synthetic construct
  source 1..14: mol_type = other DNA
cctccatcgaagcc

SEQ ID NO: 2590 - DNA, 14 bp, synthetic construct
  source 1..14: mol_type = other DNA
taaggtgaaaagga

SEQ ID NO: 2591 - DNA, 14 bp, synthetic construct
  source 1..14: mol_type = other DNA
cctacctaacccca

SEQ ID NO: 2592 - DNA, 14 bp, synthetic construct
  source 1..14: mol_type = other DNA
ctcgtcgaaacaag

SEQ ID NO: 2593 - DNA, 14 bp, synthetic construct
  source 1..14: mol_type = other DNA
aggataaaccgata

SEQ ID NO: 2594 - DNA, 14 bp, synthetic construct
  source 1..14: mol_type = other DNA
gacacagtatacgg

SEQ ID NO: 2595 - DNA, 14 bp, synthetic construct
  source 1..14: mol_type = other DNA
actgaccagctaca

SEQ ID NO: 2596 - DNA, 14 bp, synthetic construct
  source 1..14: mol_type = other DNA
tcatacgacgaaag

SEQ ID NO: 2597 - DNA, 14 bp, synthetic construct
  source 1..14: mol_type = other DNA
acgcgacgttgagg

SEQ ID NO: 2598 - DNA, 14 bp, synthetic construct
  source 1..14: mol_type = other DNA
cagataaaaatcga

SEQ ID NO: 2599 - DNA, 14 bp, synthetic construct
  source 1..14: mol_type = other DNA
ggtgtgaaaggcac

SEQ ID NO: 2600 - DNA, 14 bp, synthetic construct
  source 1..14: mol_type = other DNA
agatacgccagagt

SEQ ID NO: 2601 - DNA, 14 bp, synthetic construct
  source 1..14: mol_type = other DNA
aaggtcccgcatcg

SEQ ID NO: 2602 - DNA, 14 bp, synthetic construct
  source 1..14: mol_type = other DNA
agtacataggcggg

SEQ ID NO: 2603 - DNA, 14 bp, synthetic construct
  source 1..14: mol_type = other DNA
ccgcgtgaacgaat

SEQ ID NO: 2604 - DNA, 14 bp, synthetic construct
  source 1..14: mol_type = other DNA
ctcgagggtcggca

SEQ ID NO: 2605 - DNA, 14 bp, synthetic construct
  source 1..14: mol_type = other DNA
tgaacacataccga

SEQ ID NO: 2606 - DNA, 14 bp, synthetic construct
  source 1..14: mol_type = other DNA
gactgagctcgcac

SEQ ID NO: 2607 - DNA, 14 bp, synthetic construct
  source 1..14: mol_type = other DNA
actggaagacggta

SEQ ID NO: 2608 - DNA, 14 bp, synthetic construct
  source 1..14: mol_type = other DNA
aagccgctaccctg

SEQ ID NO: 2609 - DNA, 14 bp, synthetic construct
  source 1..14: mol_type = other DNA
gcgacgctagggtg

SEQ ID NO: 2610 - DNA, 14 bp, synthetic construct
  source 1..14: mol_type = other DNA
acctcctaggaggc

SEQ ID NO: 2611 - DNA, 14 bp, synthetic construct
  source 1..14: mol_type = other DNA
tctgggggagggag

SEQ ID NO: 2612 - DNA, 14 bp, synthetic construct
  source 1..14: mol_type = other DNA
gccgatgacatgca

SEQ ID NO: 2613 - DNA, 14 bp, synthetic construct
  source 1..14: mol_type = other DNA
ctccacacggacta

SEQ ID NO: 2614 - DNA, 14 bp, synthetic construct
  source 1..14: mol_type = other DNA
ataaccggggggct

SEQ ID NO: 2615 - DNA, 14 bp, synthetic construct
  source 1..14: mol_type = other DNA
acaagtaaagtagc

SEQ ID NO: 2616 - DNA, 14 bp, synthetic construct
  source 1..14: mol_type = other DNA
acccggatatcgaa

SEQ ID NO: 2617 - DNA, 14 bp, synthetic construct
  source 1..14: mol_type = other DNA
catgcctggaggcg

SEQ ID NO: 2618 - DNA, 14 bp, synthetic construct
  source 1..14: mol_type = other DNA
ataagtcgacgacg

SEQ ID NO: 2619 - DNA, 14 bp, synthetic construct
  source 1..14: mol_type = other DNA
agcctgcggtgggg

SEQ ID NO: 2620 - DNA, 14 bp, synthetic construct
  source 1..14: mol_type = other DNA
gcgtgcgcaataga

SEQ ID NO: 2621 - DNA, 14 bp, synthetic construct
  source 1..14: mol_type = other DNA
gcgctcgcactccc

SEQ ID NO: 2622 - DNA, 14 bp, synthetic construct
  source 1..14: mol_type = other DNA
actcacccgtggag

SEQ ID NO: 2623 - DNA, 14 bp, synthetic construct
  source 1..14: mol_type = other DNA
accactccaagtca

SEQ ID NO: 2624 - DNA, 14 bp, synthetic construct
  source 1..14: mol_type = other DNA
gtaaaatcacaagc

SEQ ID NO: 2625 - DNA, 14 bp, synthetic construct
  source 1..14: mol_type = other DNA
ggaaacataactcc

SEQ ID NO: 2626 - DNA, 14 bp, synthetic construct
  source 1..14: mol_type = other DNA
gtgcggcacaagat

SEQ ID NO: 2627 - DNA, 14 bp, synthetic construct
  source 1..14: mol_type = other DNA
aacgtataaagaac

SEQ ID NO: 2628 - DNA, 14 bp, synthetic construct
  source 1..14: mol_type = other DNA
ggaaggaaccctgt

SEQ ID NO: 2629 - DNA, 14 bp, synthetic construct
  source 1..14: mol_type = other DNA
taagacgggtacga

SEQ ID NO: 2630 - DNA, 14 bp, synthetic construct
  source 1..14: mol_type = other DNA
ccgcacctgcgtcg

SEQ ID NO: 2631 - DNA, 14 bp, synthetic construct
  source 1..14: mol_type = other DNA
tacccctgcaccag

SEQ ID NO: 2632 - DNA, 14 bp, synthetic construct
  source 1..14: mol_type = other DNA
gtcacgaaccgcct

SEQ ID NO: 2633 - DNA, 14 bp, synthetic construct
  source 1..14: mol_type = other DNA
ccgccactccagtg

SEQ ID NO: 2634 - DNA, 14 bp, synthetic construct
  source 1..14: mol_type = other DNA
ctgcaaggtcgcac

SEQ ID NO: 2635 - DNA, 14 bp, synthetic construct
  source 1..14: mol_type = other DNA
cctcacggcctggc

SEQ ID NO: 2636 - DNA, 14 bp, synthetic construct
  source 1..14: mol_type = other DNA
taaccaataggagg

SEQ ID NO: 2637 - DNA, 14 bp, synthetic construct
  source 1..14: mol_type = other DNA
gcaggagagtacat

SEQ ID NO: 2638 - DNA, 14 bp, synthetic construct
  source 1..14: mol_type = other DNA
gacgagaaaacctt

SEQ ID NO: 2639 - DNA, 14 bp, synthetic construct
  source 1..14: mol_type = other DNA
agagccaccaagtt

SEQ ID NO: 2640 - DNA, 14 bp, synthetic construct
  source 1..14: mol_type = other DNA
actaagacgcaatc

SEQ ID NO: 2641 - DNA, 14 bp, synthetic construct
  source 1..14: mol_type = other DNA
cgtggaggcccata

SEQ ID NO: 2642 - DNA, 14 bp, synthetic construct
  source 1..14: mol_type = other DNA
cggggttaggcggc

SEQ ID NO: 2643 - DNA, 14 bp, synthetic construct
  source 1..14: mol_type = other DNA
cacgaagtcacgtc

SEQ ID NO: 2644 - DNA, 14 bp, synthetic construct
  source 1..14: mol_type = other DNA
ggcctgtacgggac

SEQ ID NO: 2645 - DNA, 14 bp, synthetic construct
  source 1..14: mol_type = other DNA
caattgacgcacac

SEQ ID NO: 2646 - DNA, 14 bp, synthetic construct
  source 1..14: mol_type = other DNA
ctcacggctcaccc

SEQ ID NO: 2647 - DNA, 14 bp, synthetic construct
  source 1..14: mol_type = other DNA
acaaggggagtgta

SEQ ID NO: 2648 - DNA, 14 bp, synthetic construct
  source 1..14: mol_type = other DNA
atggtcaccccaag

SEQ ID NO: 2649 - DNA, 14 bp, synthetic construct
  source 1..14: mol_type = other DNA
ctagccctccgacc

SEQ ID NO: 2650 - DNA, 14 bp, synthetic construct
  source 1..14: mol_type = other DNA
acactatacaccac

SEQ ID NO: 2651 - DNA, 14 bp, synthetic construct
  source 1..14: mol_type = other DNA
ataagccatgcggg

SEQ ID NO: 2652 - DNA, 14 bp, synthetic construct
  source 1..14: mol_type = other DNA
tgtagacaagaagg

SEQ ID NO: 2653 - DNA, 14 bp, synthetic construct
  source 1..14: mol_type = other DNA
cccacaccgcttaa

SEQ ID NO: 2654 - DNA, 14 bp, synthetic construct
  source 1..14: mol_type = other DNA
aaccatccaacgtc

SEQ ID NO: 2655 - DNA, 14 bp, synthetic construct
  source 1..14: mol_type = other DNA
catgagtgaaaaca

SEQ ID NO: 2656 - DNA, 14 bp, synthetic construct
  source 1..14: mol_type = other DNA
aggctccgtcagac

SEQ ID NO: 2657 - DNA, 14 bp, synthetic construct
  source 1..14: mol_type = other DNA
aacgcctaactcgg

SEQ ID NO: 2658 - DNA, 14 bp, synthetic construct
  source 1..14: mol_type = other DNA
aatcagtacgggag

SEQ ID NO: 2659 - DNA, 14 bp, synthetic construct
  source 1..14: mol_type = other DNA
cacctaaacggcgt

SEQ ID NO: 2660 - DNA, 14 bp, synthetic construct
  source 1..14: mol_type = other DNA
ccatagaaactaag

SEQ ID NO: 2661 - DNA, 14 bp, synthetic construct
  source 1..14: mol_type = other DNA
gtcagtgcacaacg

SEQ ID NO: 2662 - DNA, 14 bp, synthetic construct
  source 1..14: mol_type = other DNA
tggaccggtgagcc

SEQ ID NO: 2663 - DNA, 14 bp, synthetic construct
  source 1..14: mol_type = other DNA
gatggcgctagcag

SEQ ID NO: 2664 - DNA, 14 bp, synthetic construct
  source 1..14: mol_type = other DNA
tatcagagcaccac

SEQ ID NO: 2665 - DNA, 14 bp, synthetic construct
  source 1..14: mol_type = other DNA
cactccagctcgaa

SEQ ID NO: 2666 - DNA, 14 bp, synthetic construct
  source 1..14: mol_type = other DNA
cagaggcacaattc

SEQ ID NO: 2667 - DNA, 14 bp, synthetic construct
  source 1..14: mol_type = other DNA
gggtagctgcgcac

SEQ ID NO: 2668 - DNA, 14 bp, synthetic construct
  source 1..14: mol_type = other DNA
cgatcgcaggtaag

SEQ ID NO: 2669 - DNA, 14 bp, synthetic construct
  source 1..14: mol_type = other DNA
ccacgcttacgccg

SEQ ID NO: 2670 - DNA, 14 bp, synthetic construct
  source 1..14: mol_type = other DNA
gaaccctccatacc

SEQ ID NO: 2671 - DNA, 14 bp, synthetic construct
  source 1..14: mol_type = other DNA
aaacatgcgagggt

SEQ ID NO: 2672 - DNA, 14 bp, synthetic construct
  source 1..14: mol_type = other DNA
gtgcgtgggagaga

SEQ ID NO: 2673 - DNA, 14 bp, synthetic construct
  source 1..14: mol_type = other DNA
tacagaggcctaaa

SEQ ID NO: 2674 - DNA, 14 bp, synthetic construct
  source 1..14: mol_type = other DNA
gcggcaaagcttgg

SEQ ID NO: 2675 - DNA, 14 bp, synthetic construct
  source 1..14: mol_type = other DNA
tggacatcgcgaaa

SEQ ID NO: 2676 - DNA, 14 bp, synthetic construct
  source 1..14: mol_type = other DNA
aagattggacgaac

SEQ ID NO: 2677 - DNA, 14 bp, synthetic construct
  source 1..14: mol_type = other DNA
aagactaagaagta

SEQ ID NO: 2678 - DNA, 14 bp, synthetic construct
  source 1..14: mol_type = other DNA
tggagagagcatag

SEQ ID NO: 2679 - DNA, 14 bp, synthetic construct
  source 1..14: mol_type = other DNA
ctgggtaaaaggga

SEQ ID NO: 2680 - DNA, 14 bp, synthetic construct
  source 1..14: mol_type = other DNA
gactaccgaggggt

SEQ ID NO: 2681 - DNA, 14 bp, synthetic construct
  source 1..14: mol_type = other DNA
cccagcacgcactt

SEQ ID NO: 2682 - DNA, 14 bp, synthetic construct
  source 1..14: mol_type = other DNA
gaatgggaccgtgc

SEQ ID NO: 2683 - DNA, 14 bp, synthetic construct
  source 1..14: mol_type = other DNA
catcgaaagataaa

SEQ ID NO: 2684 - DNA, 14 bp, synthetic construct
  source 1..14: mol_type = other DNA
agtaggctagagag

SEQ ID NO: 2685 - DNA, 14 bp, synthetic construct
  source 1..14: mol_type = other DNA
cgagtatacacaca

SEQ ID NO: 2686 - DNA, 14 bp, synthetic construct
  source 1..14: mol_type = other DNA
aggattgagaccga

SEQ ID NO: 2687 - DNA, 14 bp, synthetic construct
  source 1..14: mol_type = other DNA
ctcacagcggccat

SEQ ID NO: 2688 - DNA, 14 bp, synthetic construct
  source 1..14: mol_type = other DNA
tctgaacggcaacg

SEQ ID NO: 2689 - DNA, 14 bp, synthetic construct
  source 1..14: mol_type = other DNA
aatcgggactcaga

SEQ ID NO: 2690 - DNA, 14 bp, synthetic construct
  source 1..14: mol_type = other DNA
gaaagtgggtggcc

SEQ ID NO: 2691 - DNA, 14 bp, synthetic construct
  source 1..14: mol_type = other DNA
cactcgacgcgtag

SEQ ID NO: 2692 - DNA, 14 bp, synthetic construct
  source 1..14: mol_type = other DNA
gcctatggggcggg

SEQ ID NO: 2693 - DNA, 14 bp, synthetic construct
  source 1..14: mol_type = other DNA
cctaactacggagg

SEQ ID NO: 2694 - DNA, 14 bp, synthetic construct
  source 1..14: mol_type = other DNA
aagtctcccgcacg

SEQ ID NO: 2695 - DNA, 14 bp, synthetic construct
  source 1..14: mol_type = other DNA
tcggccaccaatag

SEQ ID NO: 2696 - DNA, 14 bp, synthetic construct
  source 1..14: mol_type = other DNA
gagagctggctgga

SEQ ID NO: 2697 - DNA, 14 bp, synthetic construct
  source 1..14: mol_type = other DNA
aatgcgacgcacat

SEQ ID NO: 2698 - DNA, 14 bp, synthetic construct
  source 1..14: mol_type = other DNA
gcccacacgtgtcc

SEQ ID NO: 2699 - DNA, 14 bp, synthetic construct
  source 1..14: mol_type = other DNA
gataaaaataccag

SEQ ID NO: 2700 - DNA, 14 bp, synthetic construct
  source 1..14: mol_type = other DNA
gtcacgctgggaga

SEQ ID NO: 2701 - DNA, 14 bp, synthetic construct
  source 1..14: mol_type = other DNA
aggcagtataagca

SEQ ID NO: 2702 - DNA, 14 bp, synthetic construct
  source 1..14: mol_type = other DNA
tacaacatcgaacc

SEQ ID NO: 2703 - DNA, 14 bp, synthetic construct
  source 1..14: mol_type = other DNA
ccgaagggtataac

SEQ ID NO: 2704 - DNA, 14 bp, synthetic construct
  source 1..14: mol_type = other DNA
gttgagggccgcag

SEQ ID NO: 2705 - DNA, 14 bp, synthetic construct
  source 1..14: mol_type = other DNA
gccaactgcaaaat

SEQ ID NO: 2706 - DNA, 14 bp, synthetic construct
  source 1..14: mol_type = other DNA
cggcaatccgtaac

SEQ ID NO: 2707 - DNA, 14 bp, synthetic construct
  source 1..14: mol_type = other DNA
ccgggtctaccgca

SEQ ID NO: 2708 - DNA, 14 bp, synthetic construct
  source 1..14: mol_type = other DNA
gctgagtcgggccc

SEQ ID NO: 2709 - DNA, 14 bp, synthetic construct
  source 1..14: mol_type = other DNA
ggctagatagaggc

SEQ ID NO: 2710 - DNA, 14 bp, synthetic construct
  source 1..14: mol_type = other DNA
gaagcagtgtcaaa

SEQ ID NO: 2711 - DNA, 14 bp, synthetic construct
  source 1..14: mol_type = other DNA
aaagtgccatacgc

SEQ ID NO: 2712 - DNA, 14 bp, synthetic construct
  source 1..14: mol_type = other DNA
tcgatggcgaaacc

SEQ ID NO: 2713 - DNA, 14 bp, synthetic construct
  source 1..14: mol_type = other DNA
ccccgactgctggc

SEQ ID NO: 2714 - DNA, 14 bp, synthetic construct
  source 1..14: mol_type = other DNA
aatggcacaggtcg

SEQ ID NO: 2715 - DNA, 14 bp, synthetic construct
  source 1..14: mol_type = other DNA
tccgaagcgtgaca

SEQ ID NO: 2716 - DNA, 14 bp, synthetic construct
  source 1..14: mol_type = other DNA
gatatgaacacaga

SEQ ID NO: 2717 - DNA, 14 bp, synthetic construct
  source 1..14: mol_type = other DNA
ccgagctcggcagt

SEQ ID NO: 2718 - DNA, 14 bp, synthetic construct
  source 1..14: mol_type = other DNA
gacggtagaagtca

SEQ ID NO: 2719 - DNA, 14 bp, synthetic construct
  source 1..14: mol_type = other DNA
aaacttaagaccca

SEQ ID NO: 2720 - DNA, 14 bp, synthetic construct
  source 1..14: mol_type = other DNA
gacccggagactat

SEQ ID NO: 2721 - DNA, 14 bp, synthetic construct
  source 1..14: mol_type = other DNA
cgcacgaccattag

SEQ ID NO: 2722 - DNA, 14 bp, synthetic construct
  source 1..14: mol_type = other DNA
caaaatcatcaaga

SEQ ID NO: 2723 - DNA, 14 bp, synthetic construct
  source 1..14: mol_type = other DNA
ggtctacgagcaaa

SEQ ID NO: 2724 - DNA, 14 bp, synthetic construct
  source 1..14: mol_type = other DNA
tcaccgcagagata

SEQ ID NO: 2725 - DNA, 14 bp, synthetic construct
  source 1..14: mol_type = other DNA
tggcgagcggcata

SEQ ID NO: 2726 - DNA, 14 bp, synthetic construct
  source 1..14: mol_type = other DNA
gttgccaaacagaa

SEQ ID NO: 2727 - DNA, 14 bp, synthetic construct
  source 1..14: mol_type = other DNA
ctggtaggggccac

SEQ ID NO: 2728 - DNA, 14 bp, synthetic construct
  source 1..14: mol_type = other DNA
gaaatcgactacag

SEQ ID NO: 2729 - DNA, 14 bp, synthetic construct
  source 1..14: mol_type = other DNA
tgacctcaggggag

SEQ ID NO: 2730 - DNA, 14 bp, synthetic construct
  source 1..14: mol_type = other DNA
acacgtgtcggggg

SEQ ID NO: 2731 - DNA, 14 bp, synthetic construct
  source 1..14: mol_type = other DNA
cctcgagcatgaca

SEQ ID NO: 2732 - DNA, 14 bp, synthetic construct
  source 1..14: mol_type = other DNA
cccgcttagggaag

SEQ ID NO: 2733 - DNA, 14 bp, synthetic construct
  source 1..14: mol_type = other DNA
tgtgagccgacacc

SEQ ID NO: 2734 - DNA, 14 bp, synthetic construct
  source 1..14: mol_type = other DNA
ggcggttgggagcc

SEQ ID NO: 2735 - DNA, 14 bp, synthetic construct
  source 1..14: mol_type = other DNA
ggaatcgaaaccat

SEQ ID NO: 2736 - DNA, 14 bp, synthetic construct
  source 1..14: mol_type = other DNA
acactagacgatca

SEQ ID NO: 2737 - DNA, 14 bp, synthetic construct
  source 1..14: mol_type = other DNA
gactgagcgcatcg

SEQ ID NO: 2738 - DNA, 14 bp, synthetic construct
  source 1..14: mol_type = other DNA
ataaggggatgccc

SEQ ID NO: 2739 - DNA, 14 bp, synthetic construct
  source 1..14: mol_type = other DNA
tcaccaaccggctg

SEQ ID NO: 2740 - DNA, 14 bp, synthetic construct
  source 1..14: mol_type = other DNA
ggttcggcacggac

SEQ ID NO: 2741 - DNA, 14 bp, synthetic construct
  source 1..14: mol_type = other DNA
aaacatggatcagc

SEQ ID NO: 2742 - DNA, 14 bp, synthetic construct
  source 1..14: mol_type = other DNA
agcaagtactccag

SEQ ID NO: 2743 - DNA, 14 bp, synthetic construct
  source 1..14: mol_type = other DNA
atcaagtcccgcgc

SEQ ID NO: 2744 - DNA, 14 bp, synthetic construct
  source 1..14: mol_type = other DNA
gacgctggaacctc

SEQ ID NO: 2745 - DNA, 14 bp, synthetic construct
  source 1..14: mol_type = other DNA
aaaagcgcagatct

SEQ ID NO: 2746 - DNA, 14 bp, synthetic construct
  source 1..14: mol_type = other DNA
aaagtcaactaaca

SEQ ID NO: 2747 - DNA, 14 bp, synthetic construct
  source 1..14: mol_type = other DNA
ctaactaacccccg

SEQ ID NO: 2748 - DNA, 14 bp, synthetic construct
  source 1..14: mol_type = other DNA
taagccgtgacccc

SEQ ID NO: 2749 - DNA, 14 bp, synthetic construct
  source 1..14: mol_type = other DNA
atggccctgggcga

SEQ ID NO: 2750 - DNA, 14 bp, synthetic construct
  source 1..14: mol_type = other DNA
atgagggcctcaag

SEQ ID NO: 2751 - DNA, 14 bp, synthetic construct
  source 1..14: mol_type = other DNA
gggaggtcctaaga

SEQ ID NO: 2752 - DNA, 14 bp, synthetic construct
  source 1..14: mol_type = other DNA
ttggcacagaccgc

SEQ ID NO: 2753 - DNA, 14 bp, synthetic construct
  source 1..14: mol_type = other DNA
cacttgacaaccgc

SEQ ID NO: 2754 - DNA, 14 bp, synthetic construct
  source 1..14: mol_type = other DNA
aacatacgcagcgt

SEQ ID NO: 2755 - DNA, 14 bp, synthetic construct
  source 1..14: mol_type = other DNA
cacacaggcaggtt

SEQ ID NO: 2756 - DNA, 14 bp, synthetic construct
  source 1..14: mol_type = other DNA
caccccacgactta

SEQ ID NO: 2757 - DNA, 14 bp, synthetic construct
  source 1..14: mol_type = other DNA
gggcactgtcacag

SEQ ID NO: 2758 - DNA, 14 bp, synthetic construct
  source 1..14: mol_type = other DNA
ctatagcaacagga

SEQ ID NO: 2759 - DNA, 14 bp, synthetic construct
  source 1..14: mol_type = other DNA
ctataagcgcaccc

SEQ ID NO: 2760 - DNA, 14 bp, synthetic construct
  source 1..14: mol_type = other DNA
aacgagcatagagt

SEQ ID NO: 2761 - DNA, 14 bp, synthetic construct
  source 1..14: mol_type = other DNA
agtgcagcgtacca

SEQ ID NO: 2762 - DNA, 14 bp, synthetic construct
  source 1..14: mol_type = other DNA
ctaaggagcgtacg

SEQ ID NO: 2763 - DNA, 14 bp, synthetic construct
  source 1..14: mol_type = other DNA
cgttccgagccgaa

SEQ ID NO: 2764 - DNA, 14 bp, synthetic construct
  source 1..14: mol_type = other DNA
ggataaatacgcaa

SEQ ID NO: 2765 - DNA, 14 bp, synthetic construct
  source 1..14: mol_type = other DNA
cgtcccgagtaacg

SEQ ID NO: 2766 - DNA, 14 bp, synthetic construct
  source 1..14: mol_type = other DNA
taacgtcccggaca

SEQ ID NO: 2767 - DNA, 14 bp, synthetic construct
  source 1..14: mol_type = other DNA
ctacccgacctgaa

SEQ ID NO: 2768 - DNA, 14 bp, synthetic construct
  source 1..14: mol_type = other DNA
gatagataaaacaa

SEQ ID NO: 2769 - DNA, 14 bp, synthetic construct
  source 1..14: mol_type = other DNA
ataccgactgacaa

SEQ ID NO: 2770 - DNA, 14 bp, synthetic construct
  source 1..14: mol_type = other DNA
taacgctcccccgg

SEQ ID NO: 2771 - DNA, 14 bp, synthetic construct
  source 1..14: mol_type = other DNA
cactctagcggccg

SEQ ID NO: 2772 - DNA, 14 bp, synthetic construct
  source 1..14: mol_type = other DNA
aagggagcgattcg

SEQ ID NO: 2773 - DNA, 14 bp, synthetic construct
  source 1..14: mol_type = other DNA
gaccgaatcgaggt

SEQ ID NO: 2774 - DNA, 14 bp, synthetic construct
  source 1..14: mol_type = other DNA
cacgtaagaagctc

SEQ ID NO: 2775 - DNA, 14 bp, synthetic construct
  source 1..14: mol_type = other DNA
aacgagggatactc

SEQ ID NO: 2776 - DNA, 14 bp, synthetic construct
  source 1..14: mol_type = other DNA
cagtcacgcgccct

SEQ ID NO: 2777 - DNA, 14 bp, synthetic construct
  source 1..14: mol_type = other DNA
gcaaagtgctccac

SEQ ID NO: 2778 - DNA, 14 bp, synthetic construct
  source 1..14: mol_type = other DNA
gcacgcagacgtct

SEQ ID NO: 2779 - DNA, 14 bp, synthetic construct
  source 1..14: mol_type = other DNA
agagcgcgatgcct

SEQ ID NO: 2780 - DNA, 14 bp, synthetic construct
  source 1..14: mol_type = other DNA
aatgagctcaaaaa

SEQ ID NO: 2781 - DNA, 14 bp, synthetic construct
  source 1..14: mol_type = other DNA
aacctgagcgcctc

SEQ ID NO: 2782 - DNA, 14 bp, synthetic construct
  source 1..14: mol_type = other DNA
ccccagtggcaata

SEQ ID NO: 2783 - DNA, 14 bp, synthetic construct
  source 1..14: mol_type = other DNA
gaccgcaggaattc

SEQ ID NO: 2784 - DNA, 14 bp, synthetic construct
  source 1..14: mol_type = other DNA
tagccacagcggtc

SEQ ID NO: 2785 - DNA, 14 bp, synthetic construct
  source 1..14: mol_type = other DNA
aaagtcaggcacta

SEQ ID NO: 2786 - DNA, 14 bp, synthetic construct
  source 1..14: mol_type = other DNA
cgaccagggctata

SEQ ID NO: 2787 - DNA, 14 bp, synthetic construct
  source 1..14: mol_type = other DNA
ccataagctcagaa

SEQ ID NO: 2788 - DNA, 14 bp, synthetic construct
  source 1..14: mol_type = other DNA
aggcctagagactc

SEQ ID NO: 2789 - DNA, 14 bp, synthetic construct
  source 1..14: mol_type = other DNA
taacagggaaaatg

SEQ ID NO: 2790 - DNA, 14 bp, synthetic construct
  source 1..14: mol_type = other DNA
tacggaggaatccc

SEQ ID NO: 2791 - DNA, 14 bp, synthetic construct
  source 1..14: mol_type = other DNA
cactgggtaaacgg

SEQ ID NO: 2792 - DNA, 14 bp, synthetic construct
  source 1..14: mol_type = other DNA
cttagcgcgcggcc

SEQ ID NO: 2793 - DNA, 14 bp, synthetic construct
  source 1..14: mol_type = other DNA
gctcagaaccggat

SEQ ID NO: 2794 - DNA, 14 bp, synthetic construct
  source 1..14: mol_type = other DNA
ctagtgggcaacaa

SEQ ID NO: 2795 - DNA, 14 bp, synthetic construct
  source 1..14: mol_type = other DNA
cctgtagcccccca

SEQ ID NO: 2796 - DNA, 14 bp, synthetic construct
  source 1..14: mol_type = other DNA
taacaggatggcca

SEQ ID NO: 2797 - DNA, 14 bp, synthetic construct
  source 1..14: mol_type = other DNA
cgggaactgagagt

SEQ ID NO: 2798 - DNA, 14 bp, synthetic construct
  source 1..14: mol_type = other DNA
ctgcgcagcccact

SEQ ID NO: 2799 - DNA, 14 bp, synthetic construct
  source 1..14: mol_type = other DNA
ccggacataagtac

SEQ ID NO: 2800 - DNA, 14 bp, synthetic construct
  source 1..14: mol_type = other DNA
gtccaacatgcaca

SEQ ID NO: 2801 - DNA, 14 bp, synthetic construct
  source 1..14: mol_type = other DNA
tgacaagtagagaa

SEQ ID NO: 2802 - DNA, 14 bp, synthetic construct
  source 1..14: mol_type = other DNA
ttcgacgaccggaa

SEQ ID NO: 2803 - DNA, 14 bp, synthetic construct
  source 1..14: mol_type = other DNA
cgactgccacccgt

SEQ ID NO: 2804 - DNA, 14 bp, synthetic construct
  source 1..14: mol_type = other DNA
aactaactaaacgc

SEQ ID NO: 2805 - DNA, 14 bp, synthetic construct
  source 1..14: mol_type = other DNA
caagagaggtgggt

SEQ ID NO: 2806 - DNA, 14 bp, synthetic construct
  source 1..14: mol_type = other DNA
tcggtcagaccaga

SEQ ID NO: 2807 - DNA, 14 bp, synthetic construct
  source 1..14: mol_type = other DNA
cggatcgaaggaat

SEQ ID NO: 2808 - DNA, 14 bp, synthetic construct
  source 1..14: mol_type = other DNA
catgaaactgccgg

SEQ ID NO: 2809 - DNA, 14 bp, synthetic construct
  source 1..14: mol_type = other DNA
cgcattcgccgcca

SEQ ID NO: 2810 - DNA, 14 bp, synthetic construct
  source 1..14: mol_type = other DNA
actaacctgcccgg

SEQ ID NO: 2811 - DNA, 14 bp, synthetic construct
  source 1..14: mol_type = other DNA
gcaccgaccttgaa

SEQ ID NO: 2812 - DNA, 14 bp, synthetic construct
  source 1..14: mol_type = other DNA
actgccccagtcag

SEQ ID NO: 2813 - DNA, 14 bp, synthetic construct
  source 1..14: mol_type = other DNA
atacccgacggtcg

SEQ ID NO: 2814 - DNA, 14 bp, synthetic construct
  source 1..14: mol_type = other DNA
tgagcctaaaaagc

SEQ ID NO: 2815 - DNA, 14 bp, synthetic construct
  source 1..14: mol_type = other DNA
gatcgcgcactaaa

SEQ ID NO: 2816 - DNA, 14 bp, synthetic construct
  source 1..14: mol_type = other DNA
taacacggccgcta

SEQ ID NO: 2817 - DNA, 14 bp, synthetic construct
  source 1..14: mol_type = other DNA
tcgcgagcccacta

SEQ ID NO: 2818 - DNA, 14 bp, synthetic construct
  source 1..14: mol_type = other DNA
ggccctgacacctg

SEQ ID NO: 2819 - DNA, 14 bp, synthetic construct
  source 1..14: mol_type = other DNA
cgatagggaaacct

SEQ ID NO: 2820 - DNA, 14 bp, synthetic construct
  source 1..14: mol_type = other DNA
tgactccaaagaga

SEQ ID NO: 2821 - DNA, 14 bp, synthetic construct
  source 1..14: mol_type = other DNA
gcgccattagacgg

SEQ ID NO: 2822 - DNA, 14 bp, synthetic construct
  source 1..14: mol_type = other DNA
ccccaaggatagtc

SEQ ID NO: 2823 - DNA, 14 bp, synthetic construct
  source 1..14: mol_type = other DNA
caaagtgagcgtac

SEQ ID NO: 2824 - DNA, 14 bp, synthetic construct
  source 1..14: mol_type = other DNA
ccataatacgcgac

SEQ ID NO: 2825 - DNA, 14 bp, synthetic construct
  source 1..14: mol_type = other DNA
aggggtctagcggg

SEQ ID NO: 2826 - DNA, 14 bp, synthetic construct
  source 1..14: mol_type = other DNA
cggacagagatctc

SEQ ID NO: 2827 - DNA, 14 bp, synthetic construct
  source 1..14: mol_type = other DNA
gtacagcacgtcag

SEQ ID NO: 2828 - DNA, 14 bp, synthetic construct
  source 1..14: mol_type = other DNA
aggcacatggtgag

SEQ ID NO: 2829 - DNA, 14 bp, synthetic construct
  source 1..14: mol_type = other DNA
taagaacaatacca

SEQ ID NO: 2830 - DNA, 14 bp, synthetic construct
  source 1..14: mol_type = other DNA
agagctaagatcag

SEQ ID NO: 2831 - DNA, 14 bp, synthetic construct
  source 1..14: mol_type = other DNA
gctccacgtaagaa

SEQ ID NO: 2832 - DNA, 14 bp, synthetic construct
  source 1..14: mol_type = other DNA
attgacaacgagcg

SEQ ID NO: 2833 - DNA, 14 bp, synthetic construct
  source 1..14: mol_type = other DNA
ccacaagattccaa

SEQ ID NO: 2834 - DNA, 14 bp, synthetic construct
  source 1..14: mol_type = other DNA
acacctcggtgcaa

SEQ ID NO: 2835 - DNA, 14 bp, synthetic construct
  source 1..14: mol_type = other DNA
ctgagccagcggta

SEQ ID NO: 2836 - DNA, 14 bp, synthetic construct
  source 1..14: mol_type = other DNA
actgagaccatgac

SEQ ID NO: 2837 - DNA, 14 bp, synthetic construct
  source 1..14: mol_type = other DNA
ggagaatggatgcc

SEQ ID NO: 2838 - DNA, 14 bp, synthetic construct
  source 1..14: mol_type = other DNA
cgcacgtacctaaa

SEQ ID NO: 2839 - DNA, 14 bp, synthetic construct
  source 1..14: mol_type = other DNA
gccacgcttaaagg

SEQ ID NO: 2840 - DNA, 14 bp, synthetic construct
  source 1..14: mol_type = other DNA
gacatacagcagct

SEQ ID NO: 2841 - DNA, 14 bp, synthetic construct
  source 1..14: mol_type = other DNA
aaccatgatcgaac

SEQ ID NO: 2842 - DNA, 14 bp, synthetic construct
  source 1..14: mol_type = other DNA
aagagtccgggaat

SEQ ID NO: 2843 - DNA, 14 bp, synthetic construct
  source 1..14: mol_type = other DNA
actcgagcggatcg

SEQ ID NO: 2844 - DNA, 14 bp, synthetic construct
  source 1..14: mol_type = other DNA
ttaaaaggcaccga

SEQ ID NO: 2845 - DNA, 14 bp, synthetic construct
  source 1..14: mol_type = other DNA
gggataaatcagcc

SEQ ID NO: 2846 - DNA, 14 bp, synthetic construct
  source 1..14: mol_type = other DNA
ctatcgaaagagac

SEQ ID NO: 2847 - DNA, 14 bp, synthetic construct
  source 1..14: mol_type = other DNA
aaccacactcatcc

SEQ ID NO: 2848 - DNA, 14 bp, synthetic construct
  source 1..14: mol_type = other DNA
aatcgtcgggaaag

SEQ ID NO: 2849 - DNA, 14 bp, synthetic construct
  source 1..14: mol_type = other DNA
aataagggggtggc

SEQ ID NO: 2850 - DNA, 14 bp, synthetic construct
  source 1..14: mol_type = other DNA
tagaacaagataca

SEQ ID NO: 2851 - DNA, 14 bp, synthetic construct
  source 1..14: mol_type = other DNA
actcgcgagtaaaa

SEQ ID NO: 2852 - DNA, 14 bp, synthetic construct
  source 1..14: mol_type = other DNA
gcgggtcaccctcg

SEQ ID NO: 2853 - DNA, 14 bp, synthetic construct
  source 1..14: mol_type = other DNA
gcatctgcgcggca

SEQ ID NO: 2854 - DNA, 14 bp, synthetic construct
  source 1..14: mol_type = other DNA
gttcacaggaaagc

SEQ ID NO: 2855 - DNA, 14 bp, synthetic construct
  source 1..14: mol_type = other DNA
cccgtacatagaaa

SEQ ID NO: 2856 - DNA, 14 bp, synthetic construct
  source 1..14: mol_type = other DNA
cccgcaacctgtaa

SEQ ID NO: 2857 - DNA, 14 bp, synthetic construct
  source 1..14: mol_type = other DNA
gcgttacccgccgc

SEQ ID NO: 2858 - DNA, 14 bp, synthetic construct
  source 1..14: mol_type = other DNA
gtagcacgatgcgg

SEQ ID NO: 2859 - DNA, 14 bp, synthetic construct
  source 1..14: mol_type = other DNA
cggataaagagcat

SEQ ID NO: 2860 - DNA, 14 bp, synthetic construct
  source 1..14: mol_type = other DNA
aagtacgcctccaa

SEQ ID NO: 2861 - DNA, 14 bp, synthetic construct
  source 1..14: mol_type = other DNA
ggaaacgagattca

SEQ ID NO: 2862 - DNA, 14 bp, synthetic construct
  source 1..14: mol_type = other DNA
ggagtgctgggcaa

SEQ ID NO: 2863 - DNA, 14 bp, synthetic construct
  source 1..14: mol_type = other DNA
aacggggtgcgtcg

SEQ ID NO: 2864 - DNA, 14 bp, synthetic construct
  source 1..14: mol_type = other DNA
gataagccctggca

SEQ ID NO: 2865 - DNA, 14 bp, synthetic construct
  source 1..14: mol_type = other DNA
gggtgactcacagg

SEQ ID NO: 2866 - DNA, 14 bp, synthetic construct
  source 1..14: mol_type = other DNA
tgagctagaaaaaa

SEQ ID NO: 2867 - DNA, 14 bp, synthetic construct
  source 1..14: mol_type = other DNA
cagcctgccacatc

SEQ ID NO: 2868 - DNA, 14 bp, synthetic construct
  source 1..14: mol_type = other DNA
taatcaaacaagca

SEQ ID NO: 2869 - DNA, 14 bp, synthetic construct
  source 1..14: mol_type = other DNA
cacgtgggcaatgg

SEQ ID NO: 2870 - DNA, 14 bp, synthetic construct
  source 1..14: mol_type = other DNA
ggcctagagtccac

SEQ ID NO: 2871 - DNA, 14 bp, synthetic construct
  source 1..14: mol_type = other DNA
cccttcggaggggg

SEQ ID NO: 2872 - DNA, 14 bp, synthetic construct
  source 1..14: mol_type = other DNA
agcatagagatagc

SEQ ID NO: 2873 - DNA, 14 bp, synthetic construct
  source 1..14: mol_type = other DNA
cacagaatatggac

SEQ ID NO: 2874 - DNA, 14 bp, synthetic construct
  source 1..14: mol_type = other DNA
aagtaccaccgtcg

SEQ ID NO: 2875 - DNA, 14 bp, synthetic construct
  source 1..14: mol_type = other DNA
tcaactaagagggc

SEQ ID NO: 2876 - DNA, 14 bp, synthetic construct
  source 1..14: mol_type = other DNA
ggggcaagcatatg

SEQ ID NO: 2877 - DNA, 14 bp, synthetic construct
  source 1..14: mol_type = other DNA
tgtagcaaaccgcc

SEQ ID NO: 2878 - DNA, 14 bp, synthetic construct
  source 1..14: mol_type = other DNA
cccaacgacattaa

SEQ ID NO: 2879 - DNA, 14 bp, synthetic construct
  source 1..14: mol_type = other DNA
atggcggatacctg

SEQ ID NO: 2880 - DNA, 14 bp, synthetic construct
  source 1..14: mol_type = other DNA
caagatatcatccg

SEQ ID NO: 2881 - DNA, 14 bp, synthetic construct
  source 1..14: mol_type = other DNA
atgcagtgcgctac

SEQ ID NO: 2882 - DNA, 14 bp, synthetic construct
  source 1..14: mol_type = other DNA
cagccgctgatatg

SEQ ID NO: 2883 - DNA, 14 bp, synthetic construct
  source 1..14: mol_type = other DNA
cccgttcagcatag

SEQ ID NO: 2884 - DNA, 14 bp, synthetic construct
  source 1..14: mol_type = other DNA
gaccaagttggcta

SEQ ID NO: 2885 - DNA, 14 bp, synthetic construct
  source 1..14: mol_type = other DNA
cgcggaacgctttc

SEQ ID NO: 2886 - DNA, 14 bp, synthetic construct
  source 1..14: mol_type = other DNA
ggttggcctggcgg

SEQ ID NO: 2887 - DNA, 14 bp, synthetic construct
  source 1..14: mol_type = other DNA
gctatgatcgccaa

SEQ ID NO: 2888 - DNA, 14 bp, synthetic construct
  source 1..14: mol_type = other DNA
agcgctttagcacg

SEQ ID NO: 2889 - DNA, 14 bp, synthetic construct
  source 1..14: mol_type = other DNA
ctgctctgacggag

SEQ ID NO: 2890 - DNA, 14 bp, synthetic construct
  source 1..14: mol_type = other DNA
tggggcatgctcgg

SEQ ID NO: 2891 - DNA, 14 bp, synthetic construct
  source 1..14: mol_type = other DNA
cttgccggaactcc

SEQ ID NO: 2892 - DNA, 14 bp, synthetic construct
  source 1..14: mol_type = other DNA
gctgcacatctccc

SEQ ID NO: 2893 - DNA, 14 bp, synthetic construct
  source 1..14: mol_type = other DNA
cgaatttgccccac

SEQ ID NO: 2894 - DNA, 14 bp, synthetic construct
  source 1..14: mol_type = other DNA
cggatgtaacctgc

SEQ ID NO: 2895 - DNA, 14 bp, synthetic construct
  source 1..14: mol_type = other DNA
caccaatcgtgagt

SEQ ID NO: 2896 - DNA, 14 bp, synthetic construct
  source 1..14: mol_type = other DNA
acaagatagttaaa

SEQ ID NO: 2897 - DNA, 14 bp, synthetic construct
  source 1..14: mol_type = other DNA
ttctgggaagcgga

SEQ ID NO: 2898 - DNA, 14 bp, synthetic construct
  source 1..14: mol_type = other DNA
catggaataaacgt

SEQ ID NO: 2899 - DNA, 14 bp, synthetic construct
  source 1..14: mol_type = other DNA
ctgtcaagaacact

SEQ ID NO: 2900 - DNA, 14 bp, synthetic construct
  source 1..14: mol_type = other DNA
cagatggatctacc

SEQ ID NO: 2901 - DNA, 14 bp, synthetic construct
  source 1..14: mol_type = other DNA
acgagatatggtgc

SEQ ID NO: 2902 - DNA, 14 bp, synthetic construct
  source 1..14: mol_type = other DNA
ttactgcgcacaaa

SEQ ID NO: 2903 - DNA, 14 bp, synthetic construct
  source 1..14: mol_type = other DNA
gtcaatctaagaaa

SEQ ID NO: 2904 - DNA, 14 bp, synthetic construct
  source 1..14: mol_type = other DNA
gggagcgtgtggat

SEQ ID NO: 2905 - DNA, 14 bp, synthetic construct
  source 1..14: mol_type = other DNA
tgacacatctgcgg

SEQ ID NO: 2906 - DNA, 14 bp, synthetic construct
  source 1..14: mol_type = other DNA
ttaccgccacgtag

SEQ ID NO: 2907 - DNA, 14 bp, synthetic construct
  source 1..14: mol_type = other DNA
agtacatccagtcc

SEQ ID NO: 2908 - DNA, 14 bp, synthetic construct
  source 1..14: mol_type = other DNA
ctcaacgacgtctc

SEQ ID NO: 2909 - DNA, 14 bp, synthetic construct
  source 1..14: mol_type = other DNA
gaatcgcatgggtc

SEQ ID NO: 2910 - DNA, 14 bp, synthetic construct
  source 1..14: mol_type = other DNA
tggacacgagcctt

SEQ ID NO: 2911 - DNA, 14 bp, synthetic construct
  source 1..14: mol_type = other DNA
cctacgttggcaag

SEQ ID NO: 2912 - DNA, 14 bp, synthetic construct
  source 1..14: mol_type = other DNA
gtcaccgattgcga

SEQ ID NO: 2913 - DNA, 14 bp, synthetic construct
  source 1..14: mol_type = other DNA
cgggtcctaacatc

SEQ ID NO: 2914 - DNA, 14 bp, synthetic construct
  source 1..14: mol_type = other DNA
ttgtccgcaccacc

SEQ ID NO: 2915 - DNA, 14 bp, synthetic construct
  source 1..14: mol_type = other DNA
ccagccacttctgg

SEQ ID NO: 2916 - DNA, 14 bp, synthetic construct
  source 1..14: mol_type = other DNA
agacatacctggta

SEQ ID NO: 2917 - DNA, 14 bp, synthetic construct
  source 1..14: mol_type = other DNA
gctaaccgtcgcat

SEQ ID NO: 2918 - DNA, 14 bp, synthetic construct
  source 1..14: mol_type = other DNA
tgtggaagcatgag

SEQ ID NO: 2919 - DNA, 14 bp, synthetic construct
  source 1..14: mol_type = other DNA
caggcctgtaccgt

SEQ ID NO: 2920 - DNA, 14 bp, synthetic construct
  source 1..14: mol_type = other DNA
tctgtccgaaggac

SEQ ID NO: 2921 - DNA, 14 bp, synthetic construct
  source 1..14: mol_type = other DNA
acaacgtgctgatg

SEQ ID NO: 2922 - DNA, 14 bp, synthetic construct
  source 1..14: mol_type = other DNA
gtcacagttcaaac

SEQ ID NO: 2923 - DNA, 14 bp, synthetic construct
  source 1..14: mol_type = other DNA
cagggcgttataac

SEQ ID NO: 2924 - DNA, 14 bp, synthetic construct
  source 1..14: mol_type = other DNA
ccggaatgctctaa

SEQ ID NO: 2925 - DNA, 14 bp, synthetic construct
  source 1..14: mol_type = other DNA
accttccagactag

SEQ ID NO: 2926 - DNA, 14 bp, synthetic construct
  source 1..14: mol_type = other DNA
tcaaatcaactacg

SEQ ID NO: 2927 - DNA, 14 bp, synthetic construct
  source 1..14: mol_type = other DNA
cagtggctctcggc

SEQ ID NO: 2928 - DNA, 14 bp, synthetic construct
  source 1..14: mol_type = other DNA
tagtgtcaaacaca

SEQ ID NO: 2929 - DNA, 14 bp, synthetic construct
  source 1..14: mol_type = other DNA
tgagaaaatgcagt

SEQ ID NO: 2930 - DNA, 14 bp, synthetic construct
  source 1..14: mol_type = other DNA
tcaatctagaggaa

SEQ ID NO: 2931 - DNA, 14 bp, synthetic construct
  source 1..14: mol_type = other DNA
cgcctgtgatcgcg

SEQ ID NO: 2932 - DNA, 14 bp, synthetic construct
  source 1..14: mol_type = other DNA
actacttaaaagga

SEQ ID NO: 2933 - DNA, 14 bp, synthetic construct
  source 1..14: mol_type = other DNA
gcgataattcacaa

SEQ ID NO: 2934 - DNA, 14 bp, synthetic construct
  source 1..14: mol_type = other DNA
acgaagggttacct

SEQ ID NO: 2935 - DNA, 14 bp, synthetic construct
  source 1..14: mol_type = other DNA
gggcagaataatgt

SEQ ID NO: 2936 - DNA, 14 bp, synthetic construct
  source 1..14: mol_type = other DNA
ccggatcacttagg

SEQ ID NO: 2937 - DNA, 14 bp, synthetic construct
  source 1..14: mol_type = other DNA
ctcccaatgctccc

SEQ ID NO: 2938 - DNA, 14 bp, synthetic construct
  source 1..14: mol_type = other DNA
gggttcaggtcgaa

SEQ ID NO: 2939 - DNA, 14 bp, synthetic construct
  source 1..14: mol_type = other DNA
cgtgcataccgcat

SEQ ID NO: 2940 - DNA, 14 bp, synthetic construct
  source 1..14: mol_type = other DNA
ctctcgccactaac

SEQ ID NO: 2941 - DNA, 14 bp, synthetic construct
  source 1..14: mol_type = other DNA
ccttcgagtgccgc

SEQ ID NO: 2942 - DNA, 14 bp, synthetic construct
  source 1..14: mol_type = other DNA
gttggtggacgacc

SEQ ID NO: 2943 - DNA, 14 bp, synthetic construct
  source 1..14: mol_type = other DNA
cccgtgggtgacta

SEQ ID NO: 2944 - DNA, 14 bp, synthetic construct
  source 1..14: mol_type = other DNA
gtaaactgtcccgc

SEQ ID NO: 2945 - DNA, 14 bp, synthetic construct
  source 1..14: mol_type = other DNA
atggaggggttcac

SEQ ID NO: 2946 - DNA, 14 bp, synthetic construct
  source 1..14: mol_type = other DNA
atgcggctcggggt

SEQ ID NO: 2947 - DNA, 14 bp, synthetic construct
  source 1..14: mol_type = other DNA
agcgcgtacgcgtt

SEQ ID NO: 2948 - DNA, 14 bp, synthetic construct
  source 1..14: mol_type = other DNA
acgagcatgtgcta

SEQ ID NO: 2949 - DNA, 14 bp, synthetic construct
  source 1..14: mol_type = other DNA
cccgattcatgagc

SEQ ID NO: 2950 - DNA, 14 bp, synthetic construct
  source 1..14: mol_type = other DNA
cgacttcgtcgggc

SEQ ID NO: 2951 - DNA, 14 bp, synthetic construct
  source 1..14: mol_type = other DNA
cacctattaaaggc

SEQ ID NO: 2952 - DNA, 14 bp, synthetic construct
  source 1..14: mol_type = other DNA
actgtgtggcagga

SEQ ID NO: 2953 - DNA, 14 bp, synthetic construct
  source 1..14: mol_type = other DNA
tatggaaatcacgc

SEQ ID NO: 2954 - DNA, 14 bp, synthetic construct
  source 1..14: mol_type = other DNA
cgataccccgtcgt

SEQ ID NO: 2955 - DNA, 14 bp, synthetic construct
  source 1..14: mol_type = other DNA
gcgcgatggaatta

SEQ ID NO: 2956 - DNA, 14 bp, synthetic construct
  source 1..14: mol_type = other DNA
agggtttaaaggaa

SEQ ID NO: 2957 - DNA, 14 bp, synthetic construct
  source 1..14: mol_type = other DNA
gggttggtgcaaaa

SEQ ID NO: 2958 - DNA, 14 bp, synthetic construct
  source 1..14: mol_type = other DNA
taacacccatgatg

SEQ ID NO: 2959 - DNA, 14 bp, synthetic construct
  source 1..14: mol_type = other DNA
gctagggcgattaa

SEQ ID NO: 2960 - DNA, 14 bp, synthetic construct
  source 1..14: mol_type = other DNA
aggacaaatgttag

SEQ ID NO: 2961 - DNA, 14 bp, synthetic construct
  source 1..14: mol_type = other DNA
cttgaggagtccag

SEQ ID NO: 2962 - DNA, 14 bp, synthetic construct
  source 1..14: mol_type = other DNA
ctcagatcaaacat

SEQ ID NO: 2963 - DNA, 14 bp, synthetic construct
  source 1..14: mol_type = other DNA
tcggcacgggagtt

SEQ ID NO: 2964 - DNA, 14 bp, synthetic construct
  source 1..14: mol_type = other DNA
gcgaccaagttcct

SEQ ID NO: 2965 - DNA, 14 bp, synthetic construct
  source 1..14: mol_type = other DNA
tgctcacatcggca

SEQ ID NO: 2966 - DNA, 14 bp, synthetic construct
  source 1..14: mol_type = other DNA
catggctaacgcgt

SEQ ID NO: 2967 - DNA, 14 bp, synthetic construct
  source 1..14: mol_type = other DNA
ctgcatagatgcgc

SEQ ID NO: 2968 - DNA, 14 bp, synthetic construct
  source 1..14: mol_type = other DNA
tccgagtgaggctg

SEQ ID NO: 2969 - DNA, 14 bp, synthetic construct
  source 1..14: mol_type = other DNA
tgtcgacagcgtac

SEQ ID NO: 2970 - DNA, 14 bp, synthetic construct
  source 1..14: mol_type = other DNA
cccctacacccctt

SEQ ID NO: 2971 - DNA, 14 bp, synthetic construct
  source 1..14: mol_type = other DNA
ctgtctaaggagca

SEQ ID NO: 2972 - DNA, 14 bp, synthetic construct
  source 1..14: mol_type = other DNA
caccgtcatgtgac

SEQ ID NO: 2973 - DNA, 14 bp, synthetic construct
  source 1..14: mol_type = other DNA
ttccgcactagacc

SEQ ID NO: 2974 - DNA, 14 bp, synthetic construct
  source 1..14: mol_type = other DNA
ccagatgtcgatcg

SEQ ID NO: 2975 - DNA, 14 bp, synthetic construct
  source 1..14: mol_type = other DNA
ttatgcagcagcag

SEQ ID NO: 2976 - DNA, 14 bp, synthetic construct
  source 1..14: mol_type = other DNA
gtggacaaactctc

SEQ ID NO: 2977 - DNA, 14 bp, synthetic construct
  source 1..14: mol_type = other DNA
gccacctcaatgta

SEQ ID NO: 2978 - DNA, 14 bp, synthetic construct
  source 1..14: mol_type = other DNA
cttcgagacgtgcg

SEQ ID NO: 2979 - DNA, 14 bp, synthetic construct
  source 1..14: mol_type = other DNA
gactaaccgatagt

SEQ ID NO: 2980 - DNA, 14 bp, synthetic construct
  source 1..14: mol_type = other DNA
gagtcaaaacttcc

SEQ ID NO: 2981 - DNA, 14 bp, synthetic construct
  source 1..14: mol_type = other DNA
cgtaagtgccgaat

SEQ ID NO: 2982 - DNA, 14 bp, synthetic construct
  source 1..14: mol_type = other DNA
gtaagctctaaacg

SEQ ID NO: 2983 - DNA, 14 bp, synthetic construct
  source 1..14: mol_type = other DNA
cgaaaatggtatag

SEQ ID NO: 2984 - DNA, 14 bp, synthetic construct
  source 1..14: mol_type = other DNA
gggattgctagcgc

SEQ ID NO: 2985 - DNA, 14 bp, synthetic construct
  source 1..14: mol_type = other DNA
actcaagaatcagt

SEQ ID NO: 2986 - DNA, 14 bp, synthetic construct
  source 1..14: mol_type = other DNA
cgccgaaagtgtat

SEQ ID NO: 2987 - DNA, 14 bp, synthetic construct
  source 1..14: mol_type = other DNA
cgcgttactacaag

SEQ ID NO: 2988 - DNA, 14 bp, synthetic construct
  source 1..14: mol_type = other DNA
tatggtaagggccg

SEQ ID NO: 2989 - DNA, 14 bp, synthetic construct
  source 1..14: mol_type = other DNA
tctgactgcgccga

SEQ ID NO: 2990 - DNA, 14 bp, synthetic construct
  source 1..14: mol_type = other DNA
ccagtgctatgaag

SEQ ID NO: 2991 - DNA, 14 bp, synthetic construct
  source 1..14: mol_type = other DNA
acctacaagcattc

SEQ ID NO: 2992 - DNA, 14 bp, synthetic construct
  source 1..14: mol_type = other DNA
ggattataaccgca

SEQ ID NO: 2993 - DNA, 14 bp, synthetic construct
  source 1..14: mol_type = other DNA
tcctaaagagctgg

SEQ ID NO: 2994 - DNA, 14 bp, synthetic construct
  source 1..14: mol_type = other DNA
gctaaatgaatcag

SEQ ID NO: 2995 - DNA, 14 bp, synthetic construct
  source 1..14: mol_type = other DNA
ctaaacctccccat

SEQ ID NO: 2996 - DNA, 14 bp, synthetic construct
  source 1..14: mol_type = other DNA
atgatgacgtaaca

SEQ ID NO: 2997 - DNA, 14 bp, synthetic construct
  source 1..14: mol_type = other DNA
tcggcgaagtctag

SEQ ID NO: 2998 - DNA, 14 bp, synthetic construct
  source 1..14: mol_type = other DNA
gcacctcttccgcg

SEQ ID NO: 2999 - DNA, 14 bp, synthetic construct
  source 1..14: mol_type = other DNA
tacaatggcggtac

SEQ ID NO: 3000 - DNA, 14 bp, synthetic construct
  source 1..14: mol_type = other DNA
cgtactctgcacag

SEQ ID NO: 3001 - DNA, 14 bp, synthetic construct
  source 1..14: mol_type = other DNA
aggatccgatctca

SEQ ID NO: 3002 - DNA, 14 bp, synthetic construct
  source 1..14: mol_type = other DNA
cccgtccctacctc

SEQ ID NO: 3003 - DNA, 14 bp, synthetic construct
  source 1..14: mol_type = other DNA
cggtatctaagcga

SEQ ID NO: 3004 - DNA, 14 bp, synthetic construct
  source 1..14: mol_type = other DNA
cacgttccacactc

SEQ ID NO: 3005 - DNA, 14 bp, synthetic construct
  source 1..14: mol_type = other DNA
cggattccccactg

SEQ ID NO: 3006 - DNA, 14 bp, synthetic construct
  source 1..14: mol_type = other DNA
cccctcaacctgta

SEQ ID NO: 3007 - DNA, 14 bp, synthetic construct
  source 1..14: mol_type = other DNA
caaggtacatggtc

SEQ ID NO: 3008 - DNA, 14 bp, synthetic construct
  source 1..14: mol_type = other DNA
acgcatagtctgaa

SEQ ID NO: 3009 - DNA, 14 bp, synthetic construct
  source 1..14: mol_type = other DNA
tcgttgaaaaacaa

SEQ ID NO: 3010 - DNA, 14 bp, synthetic construct
  source 1..14: mol_type = other DNA
gcgaggagttaagt

SEQ ID NO: 3011 - DNA, 14 bp, synthetic construct
  source 1..14: mol_type = other DNA
cgaagtgatcggta

SEQ ID NO: 3012 - DNA, 14 bp, synthetic construct
  source 1..14: mol_type = other DNA
tctgcgcagccgct

SEQ ID NO: 3013 - DNA, 14 bp, synthetic construct
  source 1..14: mol_type = other DNA
gagcactgatcagt

SEQ ID NO: 3014 - DNA, 14 bp, synthetic construct
  source 1..14: mol_type = other DNA
gcacgtggagtggt

SEQ ID NO: 3015 - DNA, 14 bp, synthetic construct
  source 1..14: mol_type = other DNA
gacctctagccact

SEQ ID NO: 3016 - DNA, 14 bp, synthetic construct
  source 1..14: mol_type = other DNA
tcgattgccagcaa

SEQ ID NO: 3017 - DNA, 14 bp, synthetic construct
  source 1..14: mol_type = other DNA
ccttaaaaagtaca

SEQ ID NO: 3018 - DNA, 14 bp, synthetic construct
  source 1..14: mol_type = other DNA
gtcaaggagttacg

SEQ ID NO: 3019 - DNA, 14 bp, synthetic construct
  source 1..14: mol_type = other DNA
aaatggcatctccc

SEQ ID NO: 3020 - DNA, 14 bp, synthetic construct
  source 1..14: mol_type = other DNA
caggttgcagtagc

SEQ ID NO: 3021 - DNA, 14 bp, synthetic construct
  source 1..14: mol_type = other DNA
cgaattacacctca

SEQ ID NO: 3022 - DNA, 14 bp, synthetic construct
  source 1..14: mol_type = other DNA
gctgcagggctgta

SEQ ID NO: 3023 - DNA, 14 bp, synthetic construct
  source 1..14: mol_type = other DNA
cgccctctcaaata

SEQ ID NO: 3024 - DNA, 14 bp, synthetic construct
  source 1..14: mol_type = other DNA
ccgttaggatcacc

SEQ ID NO: 3025 - DNA, 14 bp, synthetic construct
  source 1..14: mol_type = other DNA
tccgggatgatcga

SEQ ID NO: 3026 - DNA, 14 bp, synthetic construct
  source 1..14: mol_type = other DNA
acgtataggtgagc

SEQ ID NO: 3027 - DNA, 14 bp, synthetic construct
  source 1..14: mol_type = other DNA
tccaccaggtcgat

SEQ ID NO: 3028 - DNA, 14 bp, synthetic construct
  source 1..14: mol_type = other DNA
ccaaccctttagaa

SEQ ID NO: 3029 - DNA, 14 bp, synthetic construct
  source 1..14: mol_type = other DNA
atagtaggactgac

SEQ ID NO: 3030 - DNA, 14 bp, synthetic construct
  source 1..14: mol_type = other DNA
agcgcatctccagt

SEQ ID NO: 3031 - DNA, 14 bp, synthetic construct
  source 1..14: mol_type = other DNA
cttacaaagactaa

SEQ ID NO: 3032 - DNA, 14 bp, synthetic construct
  source 1..14: mol_type = other DNA
gatgcacctgcctc

SEQ ID NO: 3033 - DNA, 14 bp, synthetic construct
  source 1..14: mol_type = other DNA
agggagcccttgct

SEQ ID NO: 3034 - DNA, 14 bp, synthetic construct
  source 1..14: mol_type = other DNA
tagatgcatcccga

SEQ ID NO: 3035 - DNA, 14 bp, synthetic construct
  source 1..14: mol_type = other DNA
agcgtgttcacgcg

SEQ ID NO: 3036 - DNA, 14 bp, synthetic construct
  source 1..14: mol_type = other DNA
agttcgaccggctc

SEQ ID NO: 3037 - DNA, 14 bp, synthetic construct
  source 1..14: mol_type = other DNA
ccaagcgctttgag

SEQ ID NO: 3038 - DNA, 14 bp, synthetic construct
  source 1..14: mol_type = other DNA
aggacggcttgatc

SEQ ID NO: 3039 - DNA, 14 bp, synthetic construct
  source 1..14: mol_type = other DNA
tcactaagaaataa

SEQ ID NO: 3040 - DNA, 14 bp, synthetic construct
  source 1..14: mol_type = other DNA
cgctggatgacgtg

SEQ ID NO: 3041 - DNA, 14 bp, synthetic construct
  source 1..14: mol_type = other DNA
tacgagctgcctag

SEQ ID NO: 3042 - DNA, 14 bp, synthetic construct
  source 1..14: mol_type = other DNA
cgctccggtatggg

SEQ ID NO: 3043 - DNA, 14 bp, synthetic construct
  source 1..14: mol_type = other DNA
ctcgcctatagccc

SEQ ID NO: 3044 - DNA, 14 bp, synthetic construct
  source 1..14: mol_type = other DNA
ggaggctctctccg

SEQ ID NO: 3045 - DNA, 14 bp, synthetic construct
  source 1..14: mol_type = other DNA
aaagtgcaaattac

SEQ ID NO: 3046 - DNA, 14 bp, synthetic construct
  source 1..14: mol_type = other DNA
taaagactaggtga

SEQ ID NO: 3047 - DNA, 14 bp, synthetic construct
  source 1..14: mol_type = other DNA
gacaaccaattcta

SEQ ID NO: 3048 - DNA, 14 bp, synthetic construct
  source 1..14: mol_type = other DNA
gcagcctgaggctt

SEQ ID NO: 3049 - DNA, 14 bp, synthetic construct
  source 1..14: mol_type = other DNA
ggtagaaaatatgc

SEQ ID NO: 3050 - DNA, 14 bp, synthetic construct
  source 1..14: mol_type = other DNA
atctacgagatcgc

SEQ ID NO: 3051 - DNA, 14 bp, synthetic construct
  source 1..14: mol_type = other DNA
gatttcgcacacca

SEQ ID NO: 3052 - DNA, 14 bp, synthetic construct
  source 1..14: mol_type = other DNA
atgttgaagggcca

SEQ ID NO: 3053 - DNA, 14 bp, synthetic construct
  source 1..14: mol_type = other DNA
ttacagcgcgaagt

SEQ ID NO: 3054 - DNA, 14 bp, synthetic construct
  source 1..14: mol_type = other DNA
tatgagcctaccaa

SEQ ID NO: 3055 - DNA, 14 bp, synthetic construct
  source 1..14: mol_type = other DNA
tcaggtggctcgaa

SEQ ID NO: 3056 - DNA, 14 bp, synthetic construct
  source 1..14: mol_type = other DNA
acctaatacggcgt

SEQ ID NO: 3057 - DNA, 14 bp, synthetic construct
  source 1..14: mol_type = other DNA
ggccagaaatcttg

SEQ ID NO: 3058 - DNA, 14 bp, synthetic construct
  source 1..14: mol_type = other DNA
gtcgtatgcgcgaa

SEQ ID NO: 3059 - DNA, 14 bp, synthetic construct
  source 1..14: mol_type = other DNA
cagctaggtgtggc

SEQ ID NO: 3060 - DNA, 14 bp, synthetic construct
  source 1..14: mol_type = other DNA
gacctgggcctatg

SEQ ID NO: 3061 - DNA, 14 bp, synthetic construct
  source 1..14: mol_type = other DNA
aaaggatagtctgc

SEQ ID NO: 3062 - DNA, 14 bp, synthetic construct
  source 1..14: mol_type = other DNA
tgaggcaggtcgta

SEQ ID NO: 3063 - DNA, 14 bp, synthetic construct
  source 1..14: mol_type = other DNA
cccgtttgcacggc

SEQ ID NO: 3064 - DNA, 14 bp, synthetic construct
  source 1..14: mol_type = other DNA
gctaccaagtgatc

SEQ ID NO: 3065 - DNA, 14 bp, synthetic construct
  source 1..14: mol_type = other DNA
agtgctgtaagccg

SEQ ID NO: 3066 - DNA, 14 bp, synthetic construct
  source 1..14: mol_type = other DNA
gcgactgatctgcc

SEQ ID NO: 3067 - DNA, 14 bp, synthetic construct
  source 1..14: mol_type = other DNA
ccgcgttactcgac

SEQ ID NO: 3068 - DNA, 14 bp, synthetic construct
  source 1..14: mol_type = other DNA
gggtggagtatgaa

SEQ ID NO: 3069 - DNA, 14 bp, synthetic construct
  source 1..14: mol_type = other DNA
tccaaacgcattcc

SEQ ID NO: 3070 - DNA, 14 bp, synthetic construct
  source 1..14: mol_type = other DNA
ccctcaagcctctg

SEQ ID NO: 3071 - DNA, 14 bp, synthetic construct
  source 1..14: mol_type = other DNA
cttcgcctaagccc

SEQ ID NO: 3072 - DNA, 14 bp, synthetic construct
  source 1..14: mol_type = other DNA
atcctagcgggctg

SEQ ID NO: 3073 - DNA, 14 bp, synthetic construct
  source 1..14: mol_type = other DNA
agacggcttgaatc

SEQ ID NO: 3074 - DNA, 14 bp, synthetic construct
  source 1..14: mol_type = other DNA
tccgtagcgtccgg

SEQ ID NO: 3075 - DNA, 14 bp, synthetic construct
  source 1..14: mol_type = other DNA
cgaacccgtcctat

SEQ ID NO: 3076 - DNA, 14 bp, synthetic construct
  source 1..14: mol_type = other DNA
ctagttcgacccgg

SEQ ID NO: 3077 - DNA, 14 bp, synthetic construct
  source 1..14: mol_type = other DNA
atccattgcacgaa

SEQ ID NO: 3078 - DNA, 14 bp, synthetic construct
  source 1..14: mol_type = other DNA
acagtcataactaa

SEQ ID NO: 3079 - DNA, 14 bp, synthetic construct
  source 1..14: mol_type = other DNA
cttagctgcgacgg

SEQ ID NO: 3080 - DNA, 14 bp, synthetic construct
  source 1..14: mol_type = other DNA
taattaacccaggg

SEQ ID NO: 3081 - DNA, 14 bp, synthetic construct
  source 1..14: mol_type = other DNA
cacgatacagtgct

SEQ ID NO: 3082 - DNA, 14 bp, synthetic construct
  source 1..14: mol_type = other DNA
actgctggaatcaa

SEQ ID NO: 3083 - DNA, 14 bp, synthetic construct
  source 1..14: mol_type = other DNA
tgtagggcctggga

SEQ ID NO: 3084 - DNA, 14 bp, synthetic construct
  source 1..14: mol_type = other DNA
cggtcacctacgta

SEQ ID NO: 3085 - DNA, 14 bp, synthetic construct
  source 1..14: mol_type = other DNA
aaagcgctctatcg

SEQ ID NO: 3086 - DNA, 14 bp, synthetic construct
  source 1..14: mol_type = other DNA
ctatgagaagtccc

SEQ ID NO: 3087 - DNA, 14 bp, synthetic construct
  source 1..14: mol_type = other DNA
aaccaccagctttg

SEQ ID NO: 3088 - DNA, 14 bp, synthetic construct
  source 1..14: mol_type = other DNA
agtctacagccata

SEQ ID NO: 3089 - DNA, 14 bp, synthetic construct
  source 1..14: mol_type = other DNA
caaataactctaca

SEQ ID NO: 3090 - DNA, 14 bp, synthetic construct
  source 1..14: mol_type = other DNA
caatgcccactgat

SEQ ID NO: 3091 - DNA, 14 bp, synthetic construct
  source 1..14: mol_type = other DNA
agctccatccccgt

SEQ ID NO: 3092 - DNA, 14 bp, synthetic construct
  source 1..14: mol_type = other DNA
tagcagatagagtc

SEQ ID NO: 3093 - DNA, 14 bp, synthetic construct
  source 1..14: mol_type = other DNA
ccagtttagagcca

SEQ ID NO: 3094 - DNA, 14 bp, synthetic construct
  source 1..14: mol_type = other DNA
tgtctaaccgccaa

SEQ ID NO: 3095 - DNA, 14 bp, synthetic construct
  source 1..14: mol_type = other DNA
gctagaaatatggc

SEQ ID NO: 3096 - DNA, 14 bp, synthetic construct
  source 1..14: mol_type = other DNA
ctcgaaaccattac

SEQ ID NO: 3097 - DNA, 14 bp, synthetic construct
  source 1..14: mol_type = other DNA
actggatggatcgc

SEQ ID NO: 3098 - DNA, 14 bp, synthetic construct
  source 1..14: mol_type = other DNA
cagatagtcaaact

SEQ ID NO: 3099 - DNA, 14 bp, synthetic construct
  source 1..14: mol_type = other DNA
atgaggaattgcag

SEQ ID NO: 3100 - DNA, 14 bp, synthetic construct
  source 1..14: mol_type = other DNA
gctatggctcacac

SEQ ID NO: 3101 - DNA, 14 bp, synthetic construct
  source 1..14: mol_type = other DNA
ggaaatgtcatcaa

SEQ ID NO: 3102 - DNA, 14 bp, synthetic construct
  source 1..14: mol_type = other DNA
cgcattcgagcgtc

SEQ ID NO: 3103 - DNA, 14 bp, synthetic construct
  source 1..14: mol_type = other DNA
cccgtggtgctcac

SEQ ID NO: 3104 - DNA, 14 bp, synthetic construct
  source 1..14: mol_type = other DNA
aaagtactcccact

SEQ ID NO: 3105 - DNA, 14 bp, synthetic construct
  source 1..14: mol_type = other DNA
attaactggagaaa

SEQ ID NO: 3106 - DNA, 14 bp, synthetic construct
  source 1..14: mol_type = other DNA
aactcacacattca

SEQ ID NO: 3107 - DNA, 14 bp, synthetic construct
  source 1..14: mol_type = other DNA
gcacttaacgggct

SEQ ID NO: 3108 - DNA, 14 bp, synthetic construct
  source 1..14: mol_type = other DNA
agggtgctagggta

SEQ ID NO: 3109 - DNA, 14 bp, synthetic construct
  source 1..14: mol_type = other DNA
accgctgtcgtagc

SEQ ID NO: 3110 - DNA, 14 bp, synthetic construct
  source 1..14: mol_type = other DNA
tcatatacaaggcg

SEQ ID NO: 3111 - DNA, 14 bp, synthetic construct
  source 1..14: mol_type = other DNA
gaaaagactccctt

SEQ ID NO: 3112 - DNA, 14 bp, synthetic construct
  source 1..14: mol_type = other DNA
cagatgtacggtga

SEQ ID NO: 3113 - DNA, 14 bp, synthetic construct
  source 1..14: mol_type = other DNA
tgagtggacaccgt

SEQ ID NO: 3114 - DNA, 14 bp, synthetic construct
  source 1..14: mol_type = other DNA
taaaacaggggtct

SEQ ID NO: 3115 - DNA, 14 bp, synthetic construct
  source 1..14: mol_type = other DNA
agaccgttatccgc

SEQ ID NO: 3116 - DNA, 14 bp, synthetic construct
  source 1..14: mol_type = other DNA
agctatcaaaataa

SEQ ID NO: 3117 - DNA, 14 bp, synthetic construct
  source 1..14: mol_type = other DNA
ttgcgccacacctc

SEQ ID NO: 3118 - DNA, 14 bp, synthetic construct
  source 1..14: mol_type = other DNA
gataaacggcgttc

SEQ ID NO: 3119 - DNA, 14 bp, synthetic construct
  source 1..14: mol_type = other DNA
gtagtgggccaagt

SEQ ID NO: 3120 - DNA, 14 bp, synthetic construct
  source 1..14: mol_type = other DNA
tggcactaacacct

SEQ ID NO: 3121 - DNA, 14 bp, synthetic construct
  source 1..14: mol_type = other DNA
gtcaaaacgctgtc

SEQ ID NO: 3122 - DNA, 14 bp, synthetic construct
  source 1..14: mol_type = other DNA
gggttacgcaccat

SEQ ID NO: 3123 - DNA, 14 bp, synthetic construct
  source 1..14: mol_type = other DNA
tactggaggagtga

SEQ ID NO: 3124 - DNA, 14 bp, synthetic construct
  source 1..14: mol_type = other DNA
gacgaacgagtttg

SEQ ID NO: 3125 - DNA, 14 bp, synthetic construct
  source 1..14: mol_type = other DNA
agccgaattggtaa

SEQ ID NO: 3126 - DNA, 14 bp, synthetic construct
  source 1..14: mol_type = other DNA
ccgagccacttctc

SEQ ID NO: 3127 - DNA, 14 bp, synthetic construct
  source 1..14: mol_type = other DNA
gtgccacctaggct

SEQ ID NO: 3128 - DNA, 14 bp, synthetic construct
  source 1..14: mol_type = other DNA
tgatagtgaggagg

SEQ ID NO: 3129 - DNA, 14 bp, synthetic construct
  source 1..14: mol_type = other DNA
gtactgccggtgca

SEQ ID NO: 3130 - DNA, 14 bp, synthetic construct
  source 1..14: mol_type = other DNA
gagatttagcaagc

SEQ ID NO: 3131 - DNA, 14 bp, synthetic construct
  source 1..14: mol_type = other DNA
taaccacgtaaact

SEQ ID NO: 3132 - DNA, 14 bp, synthetic construct
  source 1..14: mol_type = other DNA
ggtccccgatgcgt

SEQ ID NO: 3133 - DNA, 14 bp, synthetic construct
  source 1..14: mol_type = other DNA
gtgaggagattacc

SEQ ID NO: 3134 - DNA, 14 bp, synthetic construct
  source 1..14: mol_type = other DNA
gctttagggacaaa

SEQ ID NO: 3135 - DNA, 14 bp, synthetic construct
  source 1..14: mol_type = other DNA
ctcaaaggtaaggt

SEQ ID NO: 3136 - DNA, 14 bp, synthetic construct
  source 1..14: mol_type = other DNA
gggactagtgggtc

SEQ ID NO: 3137 - DNA, 14 bp, synthetic construct
  source 1..14: mol_type = other DNA
gaggctcgtaagat

SEQ ID NO: 3138 - DNA, 14 bp, synthetic construct
  source 1..14: mol_type = other DNA
tgggctgcgggagt

SEQ ID NO: 3139 - DNA, 14 bp, synthetic construct
  source 1..14: mol_type = other DNA
cctgtacgacctac

SEQ ID NO: 3140 - DNA, 14 bp, synthetic construct
  source 1..14: mol_type = other DNA
cctcggacatggtg

SEQ ID NO: 3141 - DNA, 14 bp, synthetic construct
  source 1..14: mol_type = other DNA
cttactgaaacgag

SEQ ID NO: 3142 - DNA, 14 bp, synthetic construct
  source 1..14: mol_type = other DNA
gctgggactagtac

SEQ ID NO: 3143 - DNA, 14 bp, synthetic construct
  source 1..14: mol_type = other DNA
ctccatcactccgg

SEQ ID NO: 3144 - DNA, 14 bp, synthetic construct
  source 1..14: mol_type = other DNA
gtgggagtataagg

SEQ ID NO: 3145 - DNA, 14 bp, synthetic construct
  source 1..14: mol_type = other DNA
aaagcgtaggtcat

SEQ ID NO: 3146 - DNA, 14 bp, synthetic construct
  source 1..14: mol_type = other DNA
taaagtgggaccat

SEQ ID NO: 3147 - DNA, 14 bp, synthetic construct
  source 1..14: mol_type = other DNA
cgactctaggggat

SEQ ID NO: 3148 - DNA, 14 bp, synthetic construct
  source 1..14: mol_type = other DNA
acggctctatgacc

SEQ ID NO: 3149 - DNA, 14 bp, synthetic construct
  source 1..14: mol_type = other DNA
ttcgcctccccggc

SEQ ID NO: 3150 - DNA, 14 bp, synthetic construct
  source 1..14: mol_type = other DNA
actcctagcgataa

SEQ ID NO: 3151 - DNA, 14 bp, synthetic construct
  source 1..14: mol_type = other DNA
ctgtcgacccctac

SEQ ID NO: 3152 - DNA, 14 bp, synthetic construct
  source 1..14: mol_type = other DNA
ccatggatcgagct

SEQ ID NO: 3153 - DNA, 14 bp, synthetic construct
  source 1..14: mol_type = other DNA
ggcgtgctcaaaat

SEQ ID NO: 3154 - DNA, 14 bp, synthetic construct
  source 1..14: mol_type = other DNA
cggcatgatccctg

SEQ ID NO: 3155 - DNA, 14 bp, synthetic construct
  source 1..14: mol_type = other DNA
tgaatagcggtaag

SEQ ID NO: 3156 - DNA, 14 bp, synthetic construct
  source 1..14: mol_type = other DNA
cattgaggcaaggt

SEQ ID NO: 3157 - DNA, 14 bp, synthetic construct
  source 1..14: mol_type = other DNA
acattcgagcggta

SEQ ID NO: 3158 - DNA, 14 bp, synthetic construct
  source 1..14: mol_type = other DNA
atagcaggataact

SEQ ID NO: 3159 - DNA, 14 bp, synthetic construct
  source 1..14: mol_type = other DNA
gacagacacctttg

SEQ ID NO: 3160 - DNA, 14 bp, synthetic construct
  source 1..14: mol_type = other DNA
attgcagtaaaaaa

SEQ ID NO: 3161 - DNA, 14 bp, synthetic construct
  source 1..14: mol_type = other DNA
cgcatcttgagccc

SEQ ID NO: 3162 - DNA, 14 bp, synthetic construct
  source 1..14: mol_type = other DNA
ctatgcagctacca

SEQ ID NO: 3163 - DNA, 14 bp, synthetic construct
  source 1..14: mol_type = other DNA
gtagtgctcagcgc

SEQ ID NO: 3164 - DNA, 14 bp, synthetic construct
  source 1..14: mol_type = other DNA
aaacgaggtatgtg

SEQ ID NO: 3165 - DNA, 14 bp, synthetic construct
  source 1..14: mol_type = other DNA
aaagaggggtgttg

SEQ ID NO: 3166 - DNA, 14 bp, synthetic construct
  source 1..14: mol_type = other DNA
acctttgcgggggc

SEQ ID NO: 3167 - DNA, 14 bp, synthetic construct
  source 1..14: mol_type = other DNA
attgcacgacatga

SEQ ID NO: 3168 - DNA, 14 bp, synthetic construct
  source 1..14: mol_type = other DNA
cttggccatcgagg

SEQ ID NO: 3169 - DNA, 14 bp, synthetic construct
  source 1..14: mol_type = other DNA
accttaactaccag

SEQ ID NO: 3170 - DNA, 14 bp, synthetic construct
  source 1..14: mol_type = other DNA
cctgaattccagac

SEQ ID NO: 3171 - DNA, 14 bp, synthetic construct
  source 1..14: mol_type = other DNA
gtatgacataaaac

SEQ ID NO: 3172 - DNA, 14 bp, synthetic construct
  source 1..14: mol_type = other DNA
gatagtaacccgtc

SEQ ID NO: 3173 - DNA, 14 bp, synthetic construct
  source 1..14: mol_type = other DNA
accctgagcttccg

SEQ ID NO: 3174 - DNA, 14 bp, synthetic construct
  source 1..14: mol_type = other DNA
cacgaatgattcgg

SEQ ID NO: 3175 - DNA, 14 bp, synthetic construct
  source 1..14: mol_type = other DNA
cacttcctcccggg

SEQ ID NO: 3176 - DNA, 14 bp, synthetic construct
  source 1..14: mol_type = other DNA
agacctgggtggtc

SEQ ID NO: 3177 - DNA, 14 bp, synthetic construct
  source 1..14: mol_type = other DNA
taaactcgggctcc

SEQ ID NO: 3178 - DNA, 14 bp, synthetic construct
  source 1..14: mol_type = other DNA
catcgcgagcttcc

SEQ ID NO: 3179 - DNA, 14 bp, synthetic construct
  source 1..14: mol_type = other DNA
cagaatggaccctt

SEQ ID NO: 3180 - DNA, 14 bp, synthetic construct
  source 1..14: mol_type = other DNA
cagaatagcttcaa

SEQ ID NO: 3181 - DNA, 14 bp, synthetic construct
  source 1..14: mol_type = other DNA
ttcgaccgcgtaag

SEQ ID NO: 3182 - DNA, 14 bp, synthetic construct
  source 1..14: mol_type = other DNA
aggtgagcgtgatg

SEQ ID NO: 3183 - DNA, 14 bp, synthetic construct
  source 1..14: mol_type = other DNA
aagccatgcccgtt

SEQ ID NO: 3184 - DNA, 14 bp, synthetic construct
  source 1..14: mol_type = other DNA
tacctcgtgcccga

SEQ ID NO: 3185 - DNA, 14 bp, synthetic construct
  source 1..14: mol_type = other DNA
acagctaaatagtc

SEQ ID NO: 3186 - DNA, 14 bp, synthetic construct
  source 1..14: mol_type = other DNA
ggatcgaatatcgg

SEQ ID NO: 3187 - DNA, 14 bp, synthetic construct
  source 1..14: mol_type = other DNA
agttactgggacga

SEQ ID NO: 3188 - DNA, 14 bp, synthetic construct
  source 1..14: mol_type = other DNA
atcatcagagtaga

SEQ ID NO: 3189 - DNA, 14 bp, synthetic construct
  source 1..14: mol_type = other DNA
ggaaaaatcagtgt

SEQ ID NO: 3190 - DNA, 14 bp, synthetic construct
  source 1..14: mol_type = other DNA
ggtcccagcctcat

SEQ ID NO: 3191 - DNA, 14 bp, synthetic construct
  source 1..14: mol_type = other DNA
aactgttaacgacc

SEQ ID NO: 3192 - DNA, 14 bp, synthetic construct
  source 1..14: mol_type = other DNA
tgaaaagtcgacgt

SEQ ID NO: 3193 - DNA, 14 bp, synthetic construct
  source 1..14: mol_type = other DNA
caaacttgaatcca

SEQ ID NO: 3194 - DNA, 14 bp, synthetic construct
  source 1..14: mol_type = other DNA
gcttcgccagtagg

SEQ ID NO: 3195 - DNA, 14 bp, synthetic construct
  source 1..14: mol_type = other DNA
gtggcctcgcctaa

SEQ ID NO: 3196 - DNA, 14 bp, synthetic construct
  source 1..14: mol_type = other DNA
aagtgtccgcgtga

SEQ ID NO: 3197 - DNA, 14 bp, synthetic construct
  source 1..14: mol_type = other DNA
tcaccgccaatagt

SEQ ID NO: 3198 - DNA, 14 bp, synthetic construct
  source 1..14: mol_type = other DNA
attacgacgcatgg

SEQ ID NO: 3199 - DNA, 14 bp, synthetic construct
  source 1..14: mol_type = other DNA
gccacactaatggt

SEQ ID NO: 3200 - DNA, 14 bp, synthetic construct
  source 1..14: mol_type = other DNA
aatctcggtgccgg

SEQ ID NO: 3201 - DNA, 14 bp, synthetic construct
  source 1..14: mol_type = other DNA
aaatatgcaggtcg

SEQ ID NO: 3202 - DNA, 14 bp, synthetic construct
  source 1..14: mol_type = other DNA
atgaaatagatggg

SEQ ID NO: 3203 - DNA, 14 bp, synthetic construct
  source 1..14: mol_type = other DNA
tgccgagaccattc

SEQ ID NO: 3204 - DNA, 14 bp, synthetic construct
  source 1..14: mol_type = other DNA
caattcagaagtaa

SEQ ID NO: 3205 - DNA, 14 bp, synthetic construct
  source 1..14: mol_type = other DNA
gacgttctgaggcg

SEQ ID NO: 3206 - DNA, 14 bp, synthetic construct
  source 1..14: mol_type = other DNA
aatagccttaggcc

SEQ ID NO: 3207 - DNA, 14 bp, synthetic construct
  source 1..14: mol_type = other DNA
gcgcacataggtgt

SEQ ID NO: 3208 - DNA, 14 bp, synthetic construct
  source 1..14: mol_type = other DNA
gccctgattgggga

SEQ ID NO: 3209 - DNA, 14 bp, synthetic construct
  source 1..14: mol_type = other DNA
agttccgtggccac

SEQ ID NO: 3210 - DNA, 14 bp, synthetic construct
  source 1..14: mol_type = other DNA
aaaccagtttccga

SEQ ID NO: 3211 - DNA, 14 bp, synthetic construct
  source 1..14: mol_type = other DNA
agtcgcgttacaca

SEQ ID NO: 3212 - DNA, 14 bp, synthetic construct
  source 1..14: mol_type = other DNA
cgtcgggaggtgtc

SEQ ID NO: 3213 - DNA, 14 bp, synthetic construct
  source 1..14: mol_type = other DNA
tgataaaccctgca

SEQ ID NO: 3214 - DNA, 14 bp, synthetic construct
  source 1..14: mol_type = other DNA
actgcaagcttagg

SEQ ID NO: 3215 - DNA, 14 bp, synthetic construct
  source 1..14: mol_type = other DNA
caaatagcatataa

SEQ ID NO: 3216 - DNA, 14 bp, synthetic construct
  source 1..14: mol_type = other DNA
ctggccgtacctga

SEQ ID NO: 3217 - DNA, 14 bp, synthetic construct
  source 1..14: mol_type = other DNA
gatattgacgggac

SEQ ID NO: 3218 - DNA, 14 bp, synthetic construct
  source 1..14: mol_type = other DNA
gatatcaaaagtgc

SEQ ID NO: 3219 - DNA, 14 bp, synthetic construct
  source 1..14: mol_type = other DNA
ccctaattcgcccg

SEQ ID NO: 3220 - DNA, 14 bp, synthetic construct
  source 1..14: mol_type = other DNA
ggatatggaaaata

SEQ ID NO: 3221 - DNA, 14 bp, synthetic construct
  source 1..14: mol_type = other DNA
agcgcctacctact

SEQ ID NO: 3222 - DNA, 14 bp, synthetic construct
  source 1..14: mol_type = other DNA
ttgaagcatgggga

SEQ ID NO: 3223 - DNA, 14 bp, synthetic construct
  source 1..14: mol_type = other DNA
ctaacagttacaaa

SEQ ID NO: 3224 - DNA, 14 bp, synthetic construct
  source 1..14: mol_type = other DNA
actacactaaaatg

SEQ ID NO: 3225 - DNA, 14 bp, synthetic construct
  source 1..14: mol_type = other DNA
gtggacagtcctga

SEQ ID NO: 3226 - DNA, 14 bp, synthetic construct
  source 1..14: mol_type = other DNA
ttagtcagaccgcc

SEQ ID NO: 3227 - DNA, 14 bp, synthetic construct
  source 1..14: mol_type = other DNA
cagaattagacata

SEQ ID NO: 3228 - DNA, 14 bp, synthetic construct
  source 1..14: mol_type = other DNA
cactctggagggta

SEQ ID NO: 3229 - DNA, 14 bp, synthetic construct
  source 1..14: mol_type = other DNA
aactgaggcttggg

SEQ ID NO: 3230 - DNA, 14 bp, synthetic construct
  source 1..14: mol_type = other DNA
aataatggaacatg

SEQ ID NO: 3231 - DNA, 14 bp, synthetic construct
  source 1..14: mol_type = other DNA
tagaggtagagatg

SEQ ID NO: 3232 - DNA, 14 bp, synthetic construct
  source 1..14: mol_type = other DNA
acctcgactgaaat

SEQ ID NO: 3233 - DNA, 14 bp, synthetic construct
  source 1..14: mol_type = other DNA
attaggatcgaccc

SEQ ID NO: 3234 - DNA, 14 bp, synthetic construct
  source 1..14: mol_type = other DNA
cacttgcacgggct

SEQ ID NO: 3235 - DNA, 14 bp, synthetic construct
  source 1..14: mol_type = other DNA
attgagaggtacca

SEQ ID NO: 3236 - DNA, 14 bp, synthetic construct
  source 1..14: mol_type = other DNA
gatagatagacagt

SEQ ID NO: 3237 - DNA, 14 bp, synthetic construct
  source 1..14: mol_type = other DNA
gaagcatgggcatt

SEQ ID NO: 3238 - DNA, 14 bp, synthetic construct
  source 1..14: mol_type = other DNA
gcaaatcactcctg

SEQ ID NO: 3239 - DNA, 14 bp, synthetic construct
  source 1..14: mol_type = other DNA
tgcgtccaggctgc

SEQ ID NO: 3240 - DNA, 14 bp, synthetic construct
  source 1..14: mol_type = other DNA
aggtcgacgccatt

SEQ ID NO: 3241 - DNA, 14 bp, synthetic construct
  source 1..14: mol_type = other DNA
tggaggcaagtgtc

SEQ ID NO: 3242 - DNA, 14 bp, synthetic construct
  source 1..14: mol_type = other DNA
aaccccgattagtg

SEQ ID NO: 3243 - DNA, 14 bp, synthetic construct
  source 1..14: mol_type = other DNA
ttgccatgcgacac

SEQ ID NO: 3244 - DNA, 14 bp, synthetic construct
  source 1..14: mol_type = other DNA
atataaagcactaa

SEQ ID NO: 3245 - DNA, 14 bp, synthetic construct
  source 1..14: mol_type = other DNA
ggcataatagaact

SEQ ID NO: 3246 - DNA, 14 bp, synthetic construct
  source 1..14: mol_type = other DNA
gttagcggctccgc

SEQ ID NO: 3247 - DNA, 14 bp, synthetic construct
  source 1..14: mol_type = other DNA
ctacccctaaggtg

SEQ ID NO: 3248 - DNA, 14 bp, synthetic construct
  source 1..14: mol_type = other DNA
gtatgacaagtaga

SEQ ID NO: 3249 - DNA, 14 bp, synthetic construct
  source 1..14: mol_type = other DNA
tacctggcgctccc

SEQ ID NO: 3250 - DNA, 14 bp, synthetic construct
  source 1..14: mol_type = other DNA
tcgcccagcggatt

SEQ ID NO: 3251 - DNA, 14 bp, synthetic construct
  source 1..14: mol_type = other DNA
agcgcagattgtgg

SEQ ID NO: 3252 - DNA, 14 bp, synthetic construct
  source 1..14: mol_type = other DNA
catgcatctgacaa

SEQ ID NO: 3253 - DNA, 14 bp, synthetic construct
  source 1..14: mol_type = other DNA
tgctaacctacccg

SEQ ID NO: 3254 - DNA, 14 bp, synthetic construct
  source 1..14: mol_type = other DNA
ctactgtagaggga

SEQ ID NO: 3255 - DNA, 14 bp, synthetic construct
  source 1..14: mol_type = other DNA
agtgagaacaggtt

SEQ ID NO: 3256 - DNA, 14 bp, synthetic construct
  source 1..14: mol_type = other DNA
taagagaactctca

SEQ ID NO: 3257 - DNA, 14 bp, synthetic construct
  source 1..14: mol_type = other DNA
tgctcgaaggatag

SEQ ID NO: 3258 - DNA, 14 bp, synthetic construct
  source 1..14: mol_type = other DNA
aagaaaagaacttt

SEQ ID NO: 3259 - DNA, 14 bp, synthetic construct
  source 1..14: mol_type = other DNA
ttcgccctagccca

SEQ ID NO: 3260 - DNA, 14 bp, synthetic construct
  source 1..14: mol_type = other DNA
cggatcatcacagt

SEQ ID NO: 3261 - DNA, 14 bp, synthetic construct
  source 1..14: mol_type = other DNA
aagccgattggata

SEQ ID NO: 3262 - DNA, 14 bp, synthetic construct
  source 1..14: mol_type = other DNA
agattcaacgtaac

SEQ ID NO: 3263 - DNA, 14 bp, synthetic construct
  source 1..14: mol_type = other DNA
acaagagcttaggt

SEQ ID NO: 3264 - DNA, 14 bp, synthetic construct
  source 1..14: mol_type = other DNA
tccggcattccgga

SEQ ID NO: 3265 - DNA, 14 bp, synthetic construct
  source 1..14: mol_type = other DNA
gtcctcagcctccc

SEQ ID NO: 3266 - DNA, 14 bp, synthetic construct
  source 1..14: mol_type = other DNA
atcgtccgacatcc

SEQ ID NO: 3267 - DNA, 14 bp, synthetic construct
  source 1..14: mol_type = other DNA
acgcctatatgcga

SEQ ID NO: 3268 - DNA, 14 bp, synthetic construct
  source 1..14: mol_type = other DNA
atcgcacgctgctc

SEQ ID NO: 3269 - DNA, 14 bp, synthetic construct
  source 1..14: mol_type = other DNA
tcattgggaatggc

SEQ ID NO: 3270 - DNA, 14 bp, synthetic construct
  source 1..14: mol_type = other DNA
ccttacgcatcgtc

SEQ ID NO: 3271 - DNA, 14 bp, synthetic construct
  source 1..14: mol_type = other DNA
acgggttgagatgt

SEQ ID NO: 3272 - DNA, 14 bp, synthetic construct
  source 1..14: mol_type = other DNA
agaatgagggcttt

SEQ ID NO: 3273 - DNA, 14 bp, synthetic construct
  source 1..14: mol_type = other DNA
gctcaatcttgggc

SEQ ID NO: 3274 - DNA, 14 bp, synthetic construct
  source 1..14: mol_type = other DNA
gtatgcctagcatg

SEQ ID NO: 3275 - DNA, 14 bp, synthetic construct
  source 1..14: mol_type = other DNA
tcaagtcttgccaa

SEQ ID NO: 3276 - DNA, 14 bp, synthetic construct
  source 1..14: mol_type = other DNA
aatataccgtcagt

SEQ ID NO: 3277 - DNA, 14 bp, synthetic construct
  source 1..14: mol_type = other DNA
tcaacgtctctccc

SEQ ID NO: 3278 - DNA, 14 bp, synthetic construct
  source 1..14: mol_type = other DNA
atcgttgatccggg

SEQ ID NO: 3279 - DNA, 14 bp, synthetic construct
  source 1..14: mol_type = other DNA
gtgtatgacaggct

SEQ ID NO: 3280 - DNA, 14 bp, synthetic construct
  source 1..14: mol_type = other DNA
tttgcaacgtgcac

SEQ ID NO: 3281 - DNA, 14 bp, synthetic construct
  source 1..14: mol_type = other DNA
acctctggcactta

SEQ ID NO: 3282 - DNA, 14 bp, synthetic construct
  source 1..14: mol_type = other DNA
gctaaggatgaatt

SEQ ID NO: 3283 - DNA, 14 bp, synthetic construct
  source 1..14: mol_type = other DNA
gcgtctctcaatag

SEQ ID NO: 3284 - DNA, 14 bp, synthetic construct
  source 1..14: mol_type = other DNA
gccaatatgtcact

SEQ ID NO: 3285 - DNA, 14 bp, synthetic construct
  source 1..14: mol_type = other DNA
tgtaggggactcct

SEQ ID NO: 3286 - DNA, 14 bp, synthetic construct
  source 1..14: mol_type = other DNA
actcaatctagact

SEQ ID NO: 3287 - DNA, 14 bp, synthetic construct
  source 1..14: mol_type = other DNA
aggtaatctcactc

SEQ ID NO: 3288 - DNA, 14 bp, synthetic construct
  source 1..14: mol_type = other DNA
gtgcgttaggatcg

SEQ ID NO: 3289 - DNA, 14 bp, synthetic construct
  source 1..14: mol_type = other DNA
atcagagccgttat

SEQ ID NO: 3290 - DNA, 14 bp, synthetic construct
  source 1..14: mol_type = other DNA
atcgctccgccgtt

SEQ ID NO: 3291 - DNA, 14 bp, synthetic construct
  source 1..14: mol_type = other DNA
tacggggatacgtt

SEQ ID NO: 3292 - DNA, 14 bp, synthetic construct
  source 1..14: mol_type = other DNA
gatcaactattcgc

SEQ ID NO: 3293 - DNA, 14 bp, synthetic construct
  source 1..14: mol_type = other DNA
tcaagtgtatgaaa

SEQ ID NO: 3294 - DNA, 14 bp, synthetic construct
  source 1..14: mol_type = other DNA
ctcccgagtcctgt

SEQ ID NO: 3295 - DNA, 14 bp, synthetic construct
  source 1..14: mol_type = other DNA
atgctggtgccagt

SEQ ID NO: 3296 - DNA, 14 bp, synthetic construct
  source 1..14: mol_type = other DNA
atagtgcaagattg

SEQ ID NO: 3297 - DNA, 14 bp, synthetic construct
  source 1..14: mol_type = other DNA
ataggcgtctaggt

SEQ ID NO: 3298 - DNA, 14 bp, synthetic construct
  source 1..14: mol_type = other DNA
taaaatacctctgg

SEQ ID NO: 3299 - DNA, 14 bp, synthetic construct
  source 1..14: mol_type = other DNA
gctcccatcatctg

SEQ ID NO: 3300 - DNA, 14 bp, synthetic construct
  source 1..14: mol_type = other DNA
gcaactgaatatgt

SEQ ID NO: 3301 - DNA, 14 bp, synthetic construct
  source 1..14: mol_type = other DNA
gcgctttgcgaata

SEQ ID NO: 3302 - DNA, 14 bp, synthetic construct
  source 1..14: mol_type = other DNA
cttagcggagtact

SEQ ID NO: 3303 - DNA, 14 bp, synthetic construct
  source 1..14: mol_type = other DNA
tagccggtactagt

SEQ ID NO: 3304 - DNA, 14 bp, synthetic construct
  source 1..14: mol_type = other DNA
cgttaagttccgcg

SEQ ID NO: 3305 - DNA, 14 bp, synthetic construct
  source 1..14: mol_type = other DNA
ctatctggctcaga

SEQ ID NO: 3306 - DNA, 14 bp, synthetic construct
  source 1..14: mol_type = other DNA
aggattggaattgg

SEQ ID NO: 3307 - DNA, 14 bp, synthetic construct
  source 1..14: mol_type = other DNA
gatctacgtaatgc

SEQ ID NO: 3308 - DNA, 14 bp, synthetic construct
  source 1..14: mol_type = other DNA
tcgtccgaggtgta

SEQ ID NO: 3309 - DNA, 14 bp, synthetic construct
  source 1..14: mol_type = other DNA
cgttgtctagaacg

SEQ ID NO: 3310 - DNA, 14 bp, synthetic construct
  source 1..14: mol_type = other DNA
gctgatcgcgttaa

SEQ ID NO: 3311 - DNA, 14 bp, synthetic construct
  source 1..14: mol_type = other DNA
tcgggattgcggta

SEQ ID NO: 3312 - DNA, 14 bp, synthetic construct
  source 1..14: mol_type = other DNA
tgggcgaacggttt

SEQ ID NO: 3313 - DNA, 14 bp, synthetic construct
  source 1..14: mol_type = other DNA
taaccttcagtgaa

SEQ ID NO: 3314 - DNA, 14 bp, synthetic construct
  source 1..14: mol_type = other DNA
gacataccttgaat

SEQ ID NO: 3315 - DNA, 14 bp, synthetic construct
  source 1..14: mol_type = other DNA
aagaaatttcacgt

SEQ ID NO: 3316 - DNA, 14 bp, synthetic construct
  source 1..14: mol_type = other DNA
accctaggtactat

SEQ ID NO: 3317 - DNA, 14 bp, synthetic construct
  source 1..14: mol_type = other DNA
tacgcataggtgta

SEQ ID NO: 3318 - DNA, 14 bp, synthetic construct
  source 1..14: mol_type = other DNA
atcggggttctaac

SEQ ID NO: 3319 - DNA, 14 bp, synthetic construct
  source 1..14: mol_type = other DNA
gagtgctgcgggtt

SEQ ID NO: 3320 - DNA, 14 bp, synthetic construct
  source 1..14: mol_type = other DNA
cctccctccgaatt

SEQ ID NO: 3321 - DNA, 14 bp, synthetic construct
  source 1..14: mol_type = other DNA
tgccctgcgttgaa

SEQ ID NO: 3322 - DNA, 14 bp, synthetic construct
  source 1..14: mol_type = other DNA
agcgtgccatctat

SEQ ID NO: 3323 - DNA, 14 bp, synthetic construct
  source 1..14: mol_type = other DNA
tagctcaggtgagt

SEQ ID NO: 3324 - DNA, 14 bp, synthetic construct
  source 1..14: mol_type = other DNA
gaccctttcgcgta

SEQ ID NO: 3325 - DNA, 14 bp, synthetic construct
  source 1..14: mol_type = other DNA
tttaaggtcgagac

SEQ ID NO: 3326 - DNA, 14 bp, synthetic construct
  source 1..14: mol_type = other DNA
ctcgggcttacgtc

SEQ ID NO: 3327 - DNA, 14 bp, synthetic construct
  source 1..14: mol_type = other DNA
agtgggatgtgtac

SEQ ID NO: 3328 - DNA, 14 bp, synthetic construct
  source 1..14: mol_type = other DNA
gctatgtcagcggt

SEQ ID NO: 3329 - DNA, 14 bp, synthetic construct
  source 1..14: mol_type = other DNA
accggtaattccct

SEQ ID NO: 3330 - DNA, 14 bp, synthetic construct
  source 1..14: mol_type = other DNA
cgtccacttgggat

SEQ ID NO: 3331 - DNA, 14 bp, synthetic construct
  source 1..14: mol_type = other DNA
catcagtacctcta

SEQ ID NO: 3332 - DNA, 14 bp, synthetic construct
  source 1..14: mol_type = other DNA
ttagacgatatgga

SEQ ID NO: 3333 - DNA, 14 bp, synthetic construct
  source 1..14: mol_type = other DNA
ctgcgctatatggc

SEQ ID NO: 3334 - DNA, 14 bp, synthetic construct
  source 1..14: mol_type = other DNA
gtggttggaaacat

SEQ ID NO: 3335 - DNA, 14 bp, synthetic construct
  source 1..14: mol_type = other DNA
tacctgcgctacta

SEQ ID NO: 3336 - DNA, 14 bp, synthetic construct
  source 1..14: mol_type = other DNA
ttataccagccctc

SEQ ID NO: 3337 - DNA, 14 bp, synthetic construct
  source 1..14: mol_type = other DNA
ctgctcctggaatg

SEQ ID NO: 3338 - DNA, 14 bp, synthetic construct
  source 1..14: mol_type = other DNA
tcactgtgcgtcaa

SEQ ID NO: 3339 - DNA, 14 bp, synthetic construct
  source 1..14: mol_type = other DNA
tgtgaacaaaactt

SEQ ID NO: 3340 - DNA, 14 bp, synthetic construct
  source 1..14: mol_type = other DNA
ggtgtgccgtcgtc

SEQ ID NO: 3341 - DNA, 14 bp, synthetic construct
  source 1..14: mol_type = other DNA
ccttccaatataac

SEQ ID NO: 3342 - DNA, 14 bp, synthetic construct
  source 1..14: mol_type = other DNA
tgttgatgcagcac

SEQ ID NO: 3343 - DNA, 14 bp, synthetic construct
  source 1..14: mol_type = other DNA
tcttagaatcagac

SEQ ID NO: 3344 - DNA, 14 bp, synthetic construct
  source 1..14: mol_type = other DNA
gacacttaatccgt

SEQ ID NO: 3345 - DNA, 14 bp, synthetic construct
  source 1..14: mol_type = other DNA
tatgtaggtagcgc

SEQ ID NO: 3346 - DNA, 14 bp, synthetic construct
  source 1..14: mol_type = other DNA
tactccgccaattg

SEQ ID NO: 3347 - DNA, 14 bp, synthetic construct
  source 1..14: mol_type = other DNA
gcgggttctgtcgg

SEQ ID NO: 3348 - DNA, 14 bp, synthetic construct
  source 1..14: mol_type = other DNA
attacaccatgcgt

SEQ ID NO: 3349 - DNA, 14 bp, synthetic construct
  source 1..14: mol_type = other DNA
ttggcagacgttcc

SEQ ID NO: 3350 - DNA, 14 bp, synthetic construct
  source 1..14: mol_type = other DNA
actgcgtcctcctc

SEQ ID NO: 3351 - DNA, 14 bp, synthetic construct
  source 1..14: mol_type = other DNA
atcctcgaatctac

SEQ ID NO: 3352 - DNA, 14 bp, synthetic construct
  source 1..14: mol_type = other DNA
acaattgtggcgtc

SEQ ID NO: 3353 - DNA, 14 bp, synthetic construct
  source 1..14: mol_type = other DNA
ggtctagtaccatc

SEQ ID NO: 3354 - DNA, 14 bp, synthetic construct
  source 1..14: mol_type = other DNA
agaatttagtcaac

SEQ ID NO: 3355 - DNA, 14 bp, synthetic construct
  source 1..14: mol_type = other DNA
aaggtagatgtcct

SEQ ID NO: 3356 - DNA, 14 bp, synthetic construct
  source 1..14: mol_type = other DNA
tactcgctctagag

SEQ ID NO: 3357 - DNA, 14 bp, synthetic construct
  source 1..14: mol_type = other DNA
tattcacggctccc

SEQ ID NO: 3358 - DNA, 14 bp, synthetic construct
  source 1..14: mol_type = other DNA
tcgggtcgaatggt

SEQ ID NO: 3359 - DNA, 14 bp, synthetic construct
  source 1..14: mol_type = other DNA
gagtgagtgtacct

SEQ ID NO: 3360 - DNA, 14 bp, synthetic construct
  source 1..14: mol_type = other DNA
agtgtagctaatcg

SEQ ID NO: 3361 - DNA, 14 bp, synthetic construct
  source 1..14: mol_type = other DNA
gtgaccttaataag

SEQ ID NO: 3362 - DNA, 14 bp, synthetic construct
  source 1..14: mol_type = other DNA
tattgcacggaaat

SEQ ID NO: 3363 - DNA, 14 bp, synthetic construct
  source 1..14: mol_type = other DNA
ggtttgccaatccg

SEQ ID NO: 3364 - DNA, 14 bp, synthetic construct
  source 1..14: mol_type = other DNA
cagtcgttccgcct

SEQ ID NO: 3365 - DNA, 14 bp, synthetic construct
  source 1..14: mol_type = other DNA
gactggactgtgtc

SEQ ID NO: 3366 - DNA, 14 bp, synthetic construct
  source 1..14: mol_type = other DNA
accattttgaccaa

SEQ ID NO: 3367 - DNA, 14 bp, synthetic construct
  source 1..14: mol_type = other DNA
cagtgcaagttcta

SEQ ID NO: 3368 - DNA, 14 bp, synthetic construct
  source 1..14: mol_type = other DNA
gccaaatttgataa

SEQ ID NO: 3369 - DNA, 14 bp, synthetic construct
  source 1..14: mol_type = other DNA
tgacgggttggtgg

SEQ ID NO: 3370 - DNA, 14 bp, synthetic construct
  source 1..14: mol_type = other DNA
aactccattatcgc

SEQ ID NO: 3371 - DNA, 14 bp, synthetic construct
  source 1..14: mol_type = other DNA
ggttggtaagtgcc

SEQ ID NO: 3372 - DNA, 14 bp, synthetic construct
  source 1..14: mol_type = other DNA
accaatgagtcgtt

SEQ ID NO: 3373 - DNA, 14 bp, synthetic construct
  source 1..14: mol_type = other DNA
agtctttagcgacc

SEQ ID NO: 3374 - DNA, 14 bp, synthetic construct
  source 1..14: mol_type = other DNA
cttgtagaatcgaa

SEQ ID NO: 3375 - DNA, 14 bp, synthetic construct
  source 1..14: mol_type = other DNA
taacacgtcatagt

SEQ ID NO: 3376 - DNA, 14 bp, synthetic construct
  source 1..14: mol_type = other DNA
cgtagagtgagtta

SEQ ID NO: 3377 - DNA, 14 bp, synthetic construct
  source 1..14: mol_type = other DNA
acggtgtccggtct

SEQ ID NO: 3378 - DNA, 14 bp, synthetic construct
  source 1..14: mol_type = other DNA
gtcgtggctagata

SEQ ID NO: 3379 - DNA, 14 bp, synthetic construct
  source 1..14: mol_type = other DNA
tcatctactgcgag

SEQ ID NO: 3380 - DNA, 14 bp, synthetic construct
  source 1..14: mol_type = other DNA
gtgagattctgaca

SEQ ID NO: 3381 - DNA, 14 bp, synthetic construct
  source 1..14: mol_type = other DNA
actggcgcttctca

SEQ ID NO: 3382 - DNA, 14 bp, synthetic construct
  source 1..14: mol_type = other DNA
ttcccctataggag

SEQ ID NO: 3383 - DNA, 14 bp, synthetic construct
  source 1..14: mol_type = other DNA
cctatccacactta

SEQ ID NO: 3384 - DNA, 14 bp, synthetic construct
  source 1..14: mol_type = other DNA
tattcgagcaggct

SEQ ID NO: 3385 - DNA, 14 bp, synthetic construct
  source 1..14: mol_type = other DNA
cctcaactccctgt

SEQ ID NO: 3386 - DNA, 14 bp, synthetic construct
  source 1..14: mol_type = other DNA
aatccgtgaatgtg

SEQ ID NO: 3387 - DNA, 14 bp, synthetic construct
  source 1..14: mol_type = other DNA
gaggctgttcgtgc

SEQ ID NO: 3388 - DNA, 14 bp, synthetic construct
  source 1..14: mol_type = other DNA
tgcgatattagccc

SEQ ID NO: 3389 - DNA, 14 bp, synthetic construct
  source 1..14: mol_type = other DNA
agctaacatttacg

SEQ ID NO: 3390 - DNA, 14 bp, synthetic construct
  source 1..14: mol_type = other DNA
tataattacgagcc

SEQ ID NO: 3391 - DNA, 14 bp, synthetic construct
  source 1..14: mol_type = other DNA
gctggattgtcaac

SEQ ID NO: 3392 - DNA, 14 bp, synthetic construct
  source 1..14: mol_type = other DNA
ctaggcccttcgtg

SEQ ID NO: 3393 - DNA, 14 bp, synthetic construct
  source 1..14: mol_type = other DNA
gccgtccatagtgt

SEQ ID NO: 3394 - DNA, 14 bp, synthetic construct
  source 1..14: mol_type = other DNA
ctcacaggttctgg

SEQ ID NO: 3395 - DNA, 14 bp, synthetic construct
  source 1..14: mol_type = other DNA
ctgcgtttagccgg

SEQ ID NO: 3396 - DNA, 14 bp, synthetic construct
  source 1..14: mol_type = other DNA
tagcctgatcgcgt

SEQ ID NO: 3397 - DNA, 14 bp, synthetic construct
  source 1..14: mol_type = other DNA
atggtataaggggt

SEQ ID NO: 3398 - DNA, 14 bp, synthetic construct
  source 1..14: mol_type = other DNA
cttttgaacgacaa

SEQ ID NO: 3399 - DNA, 14 bp, synthetic construct
  source 1..14: mol_type = other DNA
tagtctaaacaagt

SEQ ID NO: 3400 - DNA, 14 bp, synthetic construct
  source 1..14: mol_type = other DNA
agtctattcggccg

SEQ ID NO: 3401 - DNA, 14 bp, synthetic construct
  source 1..14: mol_type = other DNA
gaactagagtatgt

SEQ ID NO: 3402 - DNA, 14 bp, synthetic construct
  source 1..14: mol_type = other DNA
gtatagatcgacta

SEQ ID NO: 3403 - DNA, 14 bp, synthetic construct
  source 1..14: mol_type = other DNA
acacttcgttcgca

SEQ ID NO: 3404 - DNA, 14 bp, synthetic construct
  source 1..14: mol_type = other DNA
ttggccaaccctct

SEQ ID NO: 3405 - DNA, 14 bp, synthetic construct
  source 1..14: mol_type = other DNA
catcagtggcctat

SEQ ID NO: 3406 - DNA, 14 bp, synthetic construct
  source 1..14: mol_type = other DNA
tagctgtcagcgct

SEQ ID NO: 3407 - DNA, 14 bp, synthetic construct
  source 1..14: mol_type = other DNA
tcaaaaagttctaa

SEQ ID NO: 3408 - DNA, 14 bp, synthetic construct
  source 1..14: mol_type = other DNA
atgatctccctccg

SEQ ID NO: 3409 - DNA, 14 bp, synthetic construct
  source 1..14: mol_type = other DNA
agcgacgtttgcat

SEQ ID NO: 3410 - DNA, 14 bp, synthetic construct
  source 1..14: mol_type = other DNA
ccgtttaagcgcgt

SEQ ID NO: 3411 - DNA, 14 bp, synthetic construct
  source 1..14: mol_type = other DNA
ggtgtcacacggtt

SEQ ID NO: 3412 - DNA, 14 bp, synthetic construct
  source 1..14: mol_type = other DNA
atgtggtcgtagac

SEQ ID NO: 3413 - DNA, 14 bp, synthetic construct
  source 1..14: mol_type = other DNA
ctccgtattgagcg

SEQ ID NO: 3414 - DNA, 14 bp, synthetic construct
  source 1..14: mol_type = other DNA
taactctctgccaa

SEQ ID NO: 3415 - DNA, 14 bp, synthetic construct
  source 1..14: mol_type = other DNA
acctgttagcacta

SEQ ID NO: 3416 - DNA, 14 bp, synthetic construct
  source 1..14: mol_type = other DNA
cagtccctttgcag

SEQ ID NO: 3417 - DNA, 14 bp, synthetic construct
  source 1..14: mol_type = other DNA
tgactattgcggac

SEQ ID NO: 3418 - DNA, 14 bp, synthetic construct
  source 1..14: mol_type = other DNA
ccgttcgttaacag

SEQ ID NO: 3419 - DNA, 14 bp, synthetic construct
  source 1..14: mol_type = other DNA
tactaagttaccga

SEQ ID NO: 3420 - DNA, 14 bp, synthetic construct
  source 1..14: mol_type = other DNA
caggatttgcgcgt

SEQ ID NO: 3421 - DNA, 14 bp, synthetic construct
  source 1..14: mol_type = other DNA
gcatttgccatgga

SEQ ID NO: 3422 - DNA, 14 bp, synthetic construct
  source 1..14: mol_type = other DNA
tgagcatgtacatc

SEQ ID NO: 3423 - DNA, 14 bp, synthetic construct
  source 1..14: mol_type = other DNA
ttgcgtatgggcca

SEQ ID NO: 3424 - DNA, 14 bp, synthetic construct
  source 1..14: mol_type = other DNA
tactgaagtctgac

SEQ ID NO: 3425 - DNA, 14 bp, synthetic construct
  source 1..14: mol_type = other DNA
cgtcctgctcacct

SEQ ID NO: 3426 - DNA, 14 bp, synthetic construct
  source 1..14: mol_type = other DNA
tgtctggtgacagg

SEQ ID NO: 3427 - DNA, 14 bp, synthetic construct
  source 1..14: mol_type = other DNA
tatggattcaaaac

SEQ ID NO: 3428 - DNA, 14 bp, synthetic construct
  source 1..14: mol_type = other DNA
ctgcacaatcgtta

SEQ ID NO: 3429 - DNA, 14 bp, synthetic construct
  source 1..14: mol_type = other DNA
cgcaaccttatcgt

SEQ ID NO: 3430 - DNA, 14 bp, synthetic construct
  source 1..14: mol_type = other DNA
tcggctataatcgc

SEQ ID NO: 3431 - DNA, 14 bp, synthetic construct
  source 1..14: mol_type = other DNA
ctggaaagacgttt

SEQ ID NO: 3432 - DNA, 14 bp, synthetic construct
  source 1..14: mol_type = other DNA
atgtatccatcccc

SEQ ID NO: 3433 - DNA, 14 bp, synthetic construct
  source 1..14: mol_type = other DNA
catctggtataacc

SEQ ID NO: 3434 - DNA, 14 bp, synthetic construct
  source 1..14: mol_type = other DNA
ccatatcatcgact

SEQ ID NO: 3435 - DNA, 14 bp, synthetic construct
  source 1..14: mol_type = other DNA
agtctcagctcgct

SEQ ID NO: 3436 - DNA, 14 bp, synthetic construct
  source 1..14: mol_type = other DNA
tctactcgaggagt

SEQ ID NO: 3437 - DNA, 14 bp, synthetic construct
  source 1..14: mol_type = other DNA
ctccatgaacaatt

SEQ ID NO: 3438 - DNA, 14 bp, synthetic construct
  source 1..14: mol_type = other DNA
ccaatcggctctgt

SEQ ID NO: 3439 - DNA, 14 bp, synthetic construct
  source 1..14: mol_type = other DNA
gctgtcctatcagc

SEQ ID NO: 3440 - DNA, 14 bp, synthetic construct
  source 1..14: mol_type = other DNA
cgatgtcctactgc

SEQ ID NO: 3441 - DNA, 14 bp, synthetic construct
  source 1..14: mol_type = other DNA
cgagatgggttact

SEQ ID NO: 3442 - DNA, 14 bp, synthetic construct
  source 1..14: mol_type = other DNA
tgttagccgcatag

SEQ ID NO: 3443 - DNA, 14 bp, synthetic construct
  source 1..14: mol_type = other DNA
agaatcctgtgatg

SEQ ID NO: 3444 - DNA, 14 bp, synthetic construct
  source 1..14: mol_type = other DNA
ttatcgtagaccga

SEQ ID NO: 3445 - DNA, 14 bp, synthetic construct
  source 1..14: mol_type = other DNA
ggagcacggatttt

SEQ ID NO: 3446 - DNA, 14 bp, synthetic construct
  source 1..14: mol_type = other DNA
cgatagagtgtaat

SEQ ID NO: 3447 - DNA, 14 bp, synthetic construct
  source 1..14: mol_type = other DNA
cagcccttgaagtt

SEQ ID NO: 3448 - DNA, 14 bp, synthetic construct
  source 1..14: mol_type = other DNA
atggcgacatcttc

SEQ ID NO: 3449 - DNA, 14 bp, synthetic construct
  source 1..14: mol_type = other DNA
ctactcgccgttac

SEQ ID NO: 3450 - DNA, 14 bp, synthetic construct
  source 1..14: mol_type = other DNA
agaaaatctttcgg

SEQ ID NO: 3451 - DNA, 14 bp, synthetic construct
  source 1..14: mol_type = other DNA
gacaatggggtgtt

SEQ ID NO: 3452 - DNA, 14 bp, synthetic construct
  source 1..14: mol_type = other DNA
gccttagcctgtag

SEQ ID NO: 3453 - DNA, 14 bp, synthetic construct
  source 1..14: mol_type = other DNA
aacggaatttggta

SEQ ID NO: 3454 - DNA, 14 bp, synthetic construct
  source 1..14: mol_type = other DNA
tgaactagaactgt

SEQ ID NO: 3455 - DNA, 14 bp, synthetic construct
  source 1..14: mol_type = other DNA
acatgtggaatcct

SEQ ID NO: 3456 - DNA, 14 bp, synthetic construct
  source 1..14: mol_type = other DNA
tacaggccatcatt

SEQ ID NO: 3457 - DNA, 14 bp, synthetic construct
  source 1..14: mol_type = other DNA
ttctctacacgaaa

SEQ ID NO: 3458 - DNA, 14 bp, synthetic construct
  source 1..14: mol_type = other DNA
acaaagatttgaat

SEQ ID NO: 3459 - DNA, 14 bp, synthetic construct
  source 1..14: mol_type = other DNA
accgttaataaata

SEQ ID NO: 3460 - DNA, 14 bp, synthetic construct
  source 1..14: mol_type = other DNA
actgatacttagcc

SEQ ID NO: 3461 - DNA, 14 bp, synthetic construct
  source 1..14: mol_type = other DNA
taccctagattcgc

SEQ ID NO: 3462 - DNA, 14 bp, synthetic construct
  source 1..14: mol_type = other DNA
ccacgatcctgttg

SEQ ID NO: 3463 - DNA, 14 bp, synthetic construct
  source 1..14: mol_type = other DNA
tgccgttcgctcgc

SEQ ID NO: 3464 - DNA, 14 bp, synthetic construct
  source 1..14: mol_type = other DNA
attgatatccgggg

SEQ ID NO: 3465 - DNA, 14 bp, synthetic construct
  source 1..14: mol_type = other DNA
gagtcgcgtcgtct

SEQ ID NO: 3466 - DNA, 14 bp, synthetic construct
  source 1..14: mol_type = other DNA
tagacagttcgctg

SEQ ID NO: 3467 - DNA, 14 bp, synthetic construct
  source 1..14: mol_type = other DNA
aatcttagagggta

SEQ ID NO: 3468 - DNA, 14 bp, synthetic construct
  source 1..14: mol_type = other DNA
ccttgaagaactgt

SEQ ID NO: 3469 - DNA, 14 bp, synthetic construct
  source 1..14: mol_type = other DNA
gtcgtgtgtgagcg

SEQ ID NO: 3470 - DNA, 14 bp, synthetic construct
  source 1..14: mol_type = other DNA
ccctggacgtatgt

SEQ ID NO: 3471 - DNA, 14 bp, synthetic construct
  source 1..14: mol_type = other DNA
ctacccgctcgatt

SEQ ID NO: 3472 - DNA, 14 bp, synthetic construct
  source 1..14: mol_type = other DNA
cgtctgcactatgg

SEQ ID NO: 3473 - DNA, 14 bp, synthetic construct
  source 1..14: mol_type = other DNA
agtgtattacaggg

SEQ ID NO: 3474 - DNA, 14 bp, synthetic construct
  source 1..14: mol_type = other DNA
atgttaggaagaat

SEQ ID NO: 3475 - DNA, 14 bp, synthetic construct
  source 1..14: mol_type = other DNA
taaccttcaaccct

SEQ ID NO: 3476 - DNA, 14 bp, synthetic construct
  source 1..14: mol_type = other DNA
gttacgccttaggg

SEQ ID NO: 3477 - DNA, 14 bp, synthetic construct
  source 1..14: mol_type = other DNA
tacatttggcgccc

SEQ ID NO: 3478 - DNA, 14 bp, synthetic construct
  source 1..14: mol_type = other DNA
actcgactgctcta

SEQ ID NO: 3479 - DNA, 14 bp, synthetic construct
  source 1..14: mol_type = other DNA
atatgcttaaacca

SEQ ID NO: 3480 - DNA, 14 bp, synthetic construct
  source 1..14: mol_type = other DNA
ttagctgtgagcaa

SEQ ID NO: 3481 - DNA, 14 bp, synthetic construct
  source 1..14: mol_type = other DNA
tggacatattaaca

SEQ ID NO: 3482 - DNA, 14 bp, synthetic construct
  source 1..14: mol_type = other DNA
ctaccgccattctc

SEQ ID NO: 3483 - DNA, 14 bp, synthetic construct
  source 1..14: mol_type = other DNA
atcttgactcgccg

SEQ ID NO: 3484 - DNA, 14 bp, synthetic construct
  source 1..14: mol_type = other DNA
taggctgattcagc

SEQ ID NO: 3485 - DNA, 14 bp, synthetic construct
  source 1..14: mol_type = other DNA
tttggtgccaaaca

SEQ ID NO: 3486 - DNA, 14 bp, synthetic construct
  source 1..14: mol_type = other DNA
cacgatctttccac

SEQ ID NO: 3487 - DNA, 14 bp, synthetic construct
  source 1..14: mol_type = other DNA
actatggttcgcgg

SEQ ID NO: 3488 - DNA, 14 bp, synthetic construct
  source 1..14: mol_type = other DNA
gtctcctgatggaa

SEQ ID NO: 3489 - DNA, 14 bp, synthetic construct
  source 1..14: mol_type = other DNA
caattgtgcaggta

SEQ ID NO: 3490 - DNA, 14 bp, synthetic construct
  source 1..14: mol_type = other DNA
tacggcgtgattgc

SEQ ID NO: 3491 - DNA, 14 bp, synthetic construct
  source 1..14: mol_type = other DNA
gagattcgtctggg

SEQ ID NO: 3492 - DNA, 14 bp, synthetic construct
  source 1..14: mol_type = other DNA
cggttaatgcctaa

SEQ ID NO: 3493 - DNA, 14 bp, synthetic construct
  source 1..14: mol_type = other DNA
gaacgctatcgttc

SEQ ID NO: 3494 - DNA, 14 bp, synthetic construct
  source 1..14: mol_type = other DNA
ctccttctgcgagg

SEQ ID NO: 3495 - DNA, 14 bp, synthetic construct
  source 1..14: mol_type = other DNA
ctgtgcatgaatcc

SEQ ID NO: 3496 - DNA, 14 bp, synthetic construct
  source 1..14: mol_type = other DNA
caatcttctaggag

SEQ ID NO: 3497 - DNA, 14 bp, synthetic construct
  source 1..14: mol_type = other DNA
gctggcactacatt

SEQ ID NO: 3498 - DNA, 14 bp, synthetic construct
  source 1..14: mol_type = other DNA
ttagcgctcgcctc

SEQ ID NO: 3499 - DNA, 14 bp, synthetic construct
  source 1..14: mol_type = other DNA
tgggggtgtcctag

SEQ ID NO: 3500 - DNA, 14 bp, synthetic construct
  source 1..14: mol_type = other DNA
ggccttacggtgtc

SEQ ID NO: 3501 - DNA, 14 bp, synthetic construct
  source 1..14: mol_type = other DNA
gtgtggagtccggt

SEQ ID NO: 3502 - DNA, 14 bp, synthetic construct
  source 1..14: mol_type = other DNA
tgtaatgcgtcgca

SEQ ID NO: 3503 - DNA, 14 bp, synthetic construct
  source 1..14: mol_type = other DNA
ctgagtgacatgat

SEQ ID NO: 3504 - DNA, 14 bp, synthetic construct
  source 1..14: mol_type = other DNA
ccttaatccgataa

SEQ ID NO: 3505 - DNA, 14 bp, synthetic construct
  source 1..14: mol_type = other DNA
atcttaaacccgtg

SEQ ID NO: 3506 - DNA, 14 bp, synthetic construct
  source 1..14: mol_type = other DNA
tcactcggtgagtc

SEQ ID NO: 3507 - DNA, 14 bp, synthetic construct
  source 1..14: mol_type = other DNA
tcacaacagctttc

SEQ ID NO: 3508 - DNA, 14 bp, synthetic construct
  source 1..14: mol_type = other DNA
atcctctgaaaatg

SEQ ID NO: 3509 - DNA, 14 bp, synthetic construct
  source 1..14: mol_type = other DNA
cgcggtccttcgat

SEQ ID NO: 3510 - DNA, 14 bp, synthetic construct
  source 1..14: mol_type = other DNA
cattaccttggacg

SEQ ID NO: 3511 - DNA, 14 bp, synthetic construct
  source 1..14: mol_type = other DNA
cccgtgcttactga

SEQ ID NO: 3512 - DNA, 14 bp, synthetic construct
  source 1..14: mol_type = other DNA
cgccacattagtct

SEQ ID NO: 3513 - DNA, 14 bp, synthetic construct
  source 1..14: mol_type = other DNA
cctgcaggcttctc

SEQ ID NO: 3514 - DNA, 14 bp, synthetic construct
  source 1..14: mol_type = other DNA
catgtgctacataa

SEQ ID NO: 3515 - DNA, 14 bp, synthetic construct
  source 1..14: mol_type = other DNA
aactaactgtatcg

SEQ ID NO: 3516 - DNA, 14 bp, synthetic construct
  source 1..14: mol_type = other DNA
ccccacttaatctg

SEQ ID NO: 3517 - DNA, 14 bp, synthetic construct
  source 1..14: mol_type = other DNA
catgattcgactac

SEQ ID NO: 3518 - DNA, 14 bp, synthetic construct
  source 1..14: mol_type = other DNA
cattgagagttcag

SEQ ID NO: 3519 - DNA, 14 bp, synthetic construct
  source 1..14: mol_type = other DNA
atcagcatgcttca

SEQ ID NO: 3520 - DNA, 14 bp, synthetic construct
  source 1..14: mol_type = other DNA
tgttaaagatcccg

SEQ ID NO: 3521 - DNA, 14 bp, synthetic construct
  source 1..14: mol_type = other DNA
atgctccggagatt

SEQ ID NO: 3522 - DNA, 14 bp, synthetic construct
  source 1..14: mol_type = other DNA
cagaaactattgtc

SEQ ID NO: 3523 - DNA, 14 bp, synthetic construct
  source 1..14: mol_type = other DNA
caattcatggtagg

SEQ ID NO: 3524 - DNA, 14 bp, synthetic construct
  source 1..14: mol_type = other DNA
cactttggcatgcc

SEQ ID NO: 3525 - DNA, 14 bp, synthetic construct
  source 1..14: mol_type = other DNA
accctcgttaagta

SEQ ID NO: 3526 - DNA, 14 bp, synthetic construct
  source 1..14: mol_type = other DNA
tcaattaagtgaca

SEQ ID NO: 3527 - DNA, 14 bp, synthetic construct
  source 1..14: mol_type = other DNA
cacaaattttcggc

SEQ ID NO: 3528 - DNA, 14 bp, synthetic construct
  source 1..14: mol_type = other DNA
aacaacgtttctgg

SEQ ID NO: 3529 - DNA, 14 bp, synthetic construct
  source 1..14: mol_type = other DNA
ccatgtgttgagga

SEQ ID NO: 3530 - DNA, 14 bp, synthetic construct
  source 1..14: mol_type = other DNA
cagcatttcacaat

SEQ ID NO: 3531 - DNA, 14 bp, synthetic construct
  source 1..14: mol_type = other DNA
tagcagatttacga

SEQ ID NO: 3532 - DNA, 14 bp, synthetic construct
  source 1..14: mol_type = other DNA
ggtaaattatcagg

SEQ ID NO: 3533 - DNA, 14 bp, synthetic construct
  source 1..14: mol_type = other DNA
aggctgctgttcgc

SEQ ID NO: 3534 - DNA, 14 bp, synthetic construct
  source 1..14: mol_type = other DNA
ggtatagcccgatt

SEQ ID NO: 3535 - DNA, 14 bp, synthetic construct
  source 1..14: mol_type = other DNA
aagttagaggtatg

SEQ ID NO: 3536 - DNA, 14 bp, synthetic construct
  source 1..14: mol_type = other DNA
agacaaatgtcttc

SEQ ID NO: 3537 - DNA, 14 bp, synthetic construct
  source 1..14: mol_type = other DNA
gtgcaatctagctc

SEQ ID NO: 3538 - DNA, 14 bp, synthetic construct
  source 1..14: mol_type = other DNA
tcgtagccgattac

SEQ ID NO: 3539 - DNA, 14 bp, synthetic construct
  source 1..14: mol_type = other DNA
tacgcatcttaccg

SEQ ID NO: 3540 - DNA, 14 bp, synthetic construct
  source 1..14: mol_type = other DNA
agtgggtcggtata

SEQ ID NO: 3541 - DNA, 14 bp, synthetic construct
  source 1..14: mol_type = other DNA
atcgcggtggtatg

SEQ ID NO: 3542 - DNA, 14 bp, synthetic construct
  source 1..14: mol_type = other DNA
tgggtgctccggct

SEQ ID NO: 3543 - DNA, 14 bp, synthetic construct
  source 1..14: mol_type = other DNA
gtatagctatggag

SEQ ID NO: 3544 - DNA, 14 bp, synthetic construct
  source 1..14: mol_type = other DNA
tattgaatgggcac

SEQ ID NO: 3545 - DNA, 14 bp, synthetic construct
  source 1..14: mol_type = other DNA
agtgaacgtgctct

SEQ ID NO: 3546 - DNA, 14 bp, synthetic construct
  source 1..14: mol_type = other DNA
accagtggtttagg

SEQ ID NO: 3547 - DNA, 14 bp, synthetic construct
  source 1..14: mol_type = other DNA
atctgaattggagc

SEQ ID NO: 3548 - DNA, 14 bp, synthetic construct
  source 1..14: mol_type = other DNA
gaactctgctaact

SEQ ID NO: 3549 - DNA, 14 bp, synthetic construct
  source 1..14: mol_type = other DNA
tgatcggagtatca

SEQ ID NO: 3550 - DNA, 14 bp, synthetic construct
  source 1..14: mol_type = other DNA
tccgtcgaattcca

SEQ ID NO: 3551 - DNA, 14 bp, synthetic construct
  source 1..14: mol_type = other DNA
agtctttccaaacg

SEQ ID NO: 3552 - DNA, 14 bp, synthetic construct
  source 1..14: mol_type = other DNA
gtgatcccctaatg

SEQ ID NO: 3553 - DNA, 14 bp, synthetic construct
  source 1..14: mol_type = other DNA
aatctgcagttcca

SEQ ID NO: 3554 - DNA, 14 bp, synthetic construct
  source 1..14: mol_type = other DNA
cttgacatcgtgac

SEQ ID NO: 3555 - DNA, 14 bp, synthetic construct
  source 1..14: mol_type = other DNA
gatagttcgtcccc

SEQ ID NO: 3556 - DNA, 14 bp, synthetic construct
  source 1..14: mol_type = other DNA
taatctggaagtgc

SEQ ID NO: 3557 - DNA, 14 bp, synthetic construct
  source 1..14: mol_type = other DNA
atcccacgttggat

SEQ ID NO: 3558 - DNA, 14 bp, synthetic construct
  source 1..14: mol_type = other DNA
acgtaattactaaa

SEQ ID NO: 3559 - DNA, 14 bp, synthetic construct
  source 1..14: mol_type = other DNA
gtcgaacctctggt

SEQ ID NO: 3560 - DNA, 14 bp, synthetic construct
  source 1..14: mol_type = other DNA
ttctgaagagatac

SEQ ID NO: 3561 - DNA, 14 bp, synthetic construct
  source 1..14: mol_type = other DNA
catgttaccaacta

SEQ ID NO: 3562 - DNA, 14 bp, synthetic construct
  source 1..14: mol_type = other DNA
aatgattcactaac

SEQ ID NO: 3563 - DNA, 14 bp, synthetic construct
  source 1..14: mol_type = other DNA
aggctttaagtcgg

SEQ ID NO: 3564 - DNA, 14 bp, synthetic construct
  source 1..14: mol_type = other DNA
ggcgatacttatag

SEQ ID NO: 3565 - DNA, 14 bp, synthetic construct
  source 1..14: mol_type = other DNA
gttgccctccgtag

SEQ ID NO: 3566 - DNA, 14 bp, synthetic construct
  source 1..14: mol_type = other DNA
ctaataaatgctca

SEQ ID NO: 3567 - DNA, 14 bp, synthetic construct
  source 1..14: mol_type = other DNA
ttccactaatagcc

SEQ ID NO: 3568 - DNA, 14 bp, synthetic construct
  source 1..14: mol_type = other DNA
ttcacaatgcgcat

SEQ ID NO: 3569 - DNA, 14 bp, synthetic construct
  source 1..14: mol_type = other DNA
tcccgtgccatatg

SEQ ID NO: 3570 - DNA, 14 bp, synthetic construct
  source 1..14: mol_type = other DNA
atagatacttccga

SEQ ID NO: 3571 - DNA, 14 bp, synthetic construct
  source 1..14: mol_type = other DNA
gggatctgtaacgt

SEQ ID NO: 3572 - DNA, 14 bp, synthetic construct
  source 1..14: mol_type = other DNA
ctagttccgaaact

SEQ ID NO: 3573 - DNA, 14 bp, synthetic construct
  source 1..14: mol_type = other DNA
agtatgaacctaat

SEQ ID NO: 3574 - DNA, 14 bp, synthetic construct
  source 1..14: mol_type = other DNA
ggggctacttctga

SEQ ID NO: 3575 - DNA, 14 bp, synthetic construct
  source 1..14: mol_type = other DNA
taaacgtcttaaaa

SEQ ID NO: 3576 - DNA, 14 bp, synthetic construct
  source 1..14: mol_type = other DNA
aaggatgtccgtct

SEQ ID NO: 3577 - DNA, 14 bp, synthetic construct
  source 1..14: mol_type = other DNA
ccggtataattcaa

SEQ ID NO: 3578 - DNA, 14 bp, synthetic construct
  source 1..14: mol_type = other DNA
atagcgaatcgctt

SEQ ID NO: 3579 - DNA, 14 bp, synthetic construct
  source 1..14: mol_type = other DNA
tggatttcgacaca

SEQ ID NO: 3580 - DNA, 14 bp, synthetic construct
  source 1..14: mol_type = other DNA
ataaggtattcaga

SEQ ID NO: 3581 - DNA, 14 bp, synthetic construct
  source 1..14: mol_type = other DNA
agtcctggtctcgg

SEQ ID NO: 3582 - DNA, 14 bp, synthetic construct
  source 1..14: mol_type = other DNA
agactagtgtgtcg

SEQ ID NO: 3583 - DNA, 14 bp, synthetic construct
  source 1..14: mol_type = other DNA
ggtgtacgttgcag

SEQ ID NO: 3584 - DNA, 14 bp, synthetic construct
  source 1..14: mol_type = other DNA
gcccgtgttcggct

SEQ ID NO: 3585 - DNA, 14 bp, synthetic construct
  source 1..14: mol_type = other DNA
atatccctatgggc

SEQ ID NO: 3586 - DNA, 14 bp, synthetic construct
  source 1..14: mol_type = other DNA
ggtcgcgagatttg

SEQ ID NO: 3587 - DNA, 14 bp, synthetic construct
  source 1..14: mol_type = other DNA
ttgatgagaaactg

SEQ ID NO: 3588 - DNA, 14 bp, synthetic construct
  source 1..14: mol_type = other DNA
cttggataccgatc

SEQ ID NO: 3589 - DNA, 14 bp, synthetic construct
  source 1..14: mol_type = other DNA
aagtttcgagctcc

SEQ ID NO: 3590 - DNA, 14 bp, synthetic construct
  source 1..14: mol_type = other DNA
agatccataatatc

SEQ ID NO: 3591 - DNA, 14 bp, synthetic construct
  source 1..14: mol_type = other DNA
actgcaattgcgta

SEQ ID NO: 3592 - DNA, 14 bp, synthetic construct
  source 1..14: mol_type = other DNA
tagtgcaactctag

SEQ ID NO: 3593 - DNA, 14 bp, synthetic construct
  source 1..14: mol_type = other DNA
tctgtgaaaactca

SEQ ID NO: 3594 - DNA, 14 bp, synthetic construct
  source 1..14: mol_type = other DNA
aaccgtctcgctct

SEQ ID NO: 3595 - DNA, 14 bp, synthetic construct
  source 1..14: mol_type = other DNA
tgttgctcgcgagg

SEQ ID NO: 3596 - DNA, 14 bp, synthetic construct
  source 1..14: mol_type = other DNA
cctcacctctagtc

SEQ ID NO: 3597 - DNA, 14 bp, synthetic construct
  source 1..14: mol_type = other DNA
aacagtttatacaa

SEQ ID NO: 3598 - DNA, 14 bp, synthetic construct
  source 1..14: mol_type = other DNA
ttgcgtagaacatg

SEQ ID NO: 3599 - DNA, 14 bp, synthetic construct
  source 1..14: mol_type = other DNA
agtccagatccctt

SEQ ID NO: 3600 - DNA, 14 bp, synthetic construct
  source 1..14: mol_type = other DNA
atgtatgcaacata

SEQ ID NO: 3601 - DNA, 14 bp, synthetic construct
  source 1..14: mol_type = other DNA
caacgattgttcac

SEQ ID NO: 3602 - DNA, 14 bp, synthetic construct
  source 1..14: mol_type = other DNA
caacttgaattgcg

SEQ ID NO: 3603 - DNA, 14 bp, synthetic construct
  source 1..14: mol_type = other DNA
atcgtaccacgtgt

SEQ ID NO: 3604 - DNA, 14 bp, synthetic construct
  source 1..14: mol_type = other DNA
atttatggaaccgc

SEQ ID NO: 3605 - DNA, 14 bp, synthetic construct
  source 1..14: mol_type = other DNA
ttcggacctaccgt

SEQ ID NO: 3606 - DNA, 14 bp, synthetic construct
  source 1..14: mol_type = other DNA
agtcggttgatacc

SEQ ID NO: 3607 - DNA, 14 bp, synthetic construct
  source 1..14: mol_type = other DNA
caccgttaacctta

SEQ ID NO: 3608 - DNA, 14 bp, synthetic construct
  source 1..14: mol_type = other DNA
gttggctgggcatc

SEQ ID NO: 3609 - DNA, 14 bp, synthetic construct
  source 1..14: mol_type = other DNA
ttgatcgcacccat

SEQ ID NO: 3610 - DNA, 14 bp, synthetic construct
  source 1..14: mol_type = other DNA
cgataaatgcatgt

SEQ ID NO: 3611 - DNA, 14 bp, synthetic construct
  source 1..14: mol_type = other DNA
agtagtcacaatta

SEQ ID NO: 3612 - DNA, 14 bp, synthetic construct
  source 1..14: mol_type = other DNA
atcggtaatggatg

SEQ ID NO: 3613 - DNA, 14 bp, synthetic construct
  source 1..14: mol_type = other DNA
aatgcactggctgt

SEQ ID NO: 3614 - DNA, 14 bp, synthetic construct
  source 1..14: mol_type = other DNA
gctcggttaagctg

SEQ ID NO: 3615 - DNA, 14 bp, synthetic construct
  source 1..14: mol_type = other DNA
gaggatttcactcg

SEQ ID NO: 3616 - DNA, 14 bp, synthetic construct
  source 1..14: mol_type = other DNA
tgatctgggactaa

SEQ ID NO: 3617 - DNA, 14 bp, synthetic construct
  source 1..14: mol_type = other DNA
tatgacttagagac

SEQ ID NO: 3618 - DNA, 14 bp, synthetic construct
  source 1..14: mol_type = other DNA
acagtcgaatcttg

SEQ ID NO: 3619 - DNA, 14 bp, synthetic construct
  source 1..14: mol_type = other DNA
tatcctacgctgcc

SEQ ID NO: 3620 - DNA, 14 bp, synthetic construct
  source 1..14: mol_type = other DNA
gctcggggtccatt

SEQ ID NO: 3621 - DNA, 14 bp, synthetic construct
  source 1..14: mol_type = other DNA
atcaatcctgtagg

SEQ ID NO: 3622 - DNA, 14 bp, synthetic construct
  source 1..14: mol_type = other DNA
atcgacagtccgtt

SEQ ID NO: 3623 - DNA, 14 bp, synthetic construct
  source 1..14: mol_type = other DNA
aggctcgttaatgc

SEQ ID NO: 3624 - DNA, 14 bp, synthetic construct
  source 1..14: mol_type = other DNA
gagggtttaggctc

SEQ ID NO: 3625 - DNA, 14 bp, synthetic construct
  source 1..14: mol_type = other DNA
gtcgctagacttac

SEQ ID NO: 3626 - DNA, 14 bp, synthetic construct
  source 1..14: mol_type = other DNA
ggatggtgctacct

SEQ ID NO: 3627 - DNA, 14 bp, synthetic construct
  source 1..14: mol_type = other DNA
acgtccccattcct

SEQ ID NO: 3628 - DNA, 14 bp, synthetic construct
  source 1..14: mol_type = other DNA
ttagaagcctgtaa

SEQ ID NO: 3629 - DNA, 14 bp, synthetic construct
  source 1..14: mol_type = other DNA
gaattactcatgag

SEQ ID NO: 3630 - DNA, 14 bp, synthetic construct
  source 1..14: mol_type = other DNA
tcaggacttatggg

SEQ ID NO: 3631 - DNA, 14 bp, synthetic construct
  source 1..14: mol_type = other DNA
ggcactattatagc

SEQ ID NO: 3632 - DNA, 14 bp, synthetic construct
  source 1..14: mol_type = other DNA
tctgcgtgcgaggt

SEQ ID NO: 3633 - DNA, 14 bp, synthetic construct
  source 1..14: mol_type = other DNA
tgttcactacgaaa

SEQ ID NO: 3634 - DNA, 14 bp, synthetic construct
  source 1..14: mol_type = other DNA
tatcatcacctcag

SEQ ID NO: 3635 - DNA, 14 bp, synthetic construct
  source 1..14: mol_type = other DNA
ttatggccacatcc

SEQ ID NO: 3636 - DNA, 14 bp, synthetic construct
  source 1..14: mol_type = other DNA
tcacgtctcggctc

SEQ ID NO: 3637 - DNA, 14 bp, synthetic construct
  source 1..14: mol_type = other DNA
ctcttcatagacgc

SEQ ID NO: 3638 - DNA, 14 bp, synthetic construct
  source 1..14: mol_type = other DNA
tcattcgtaccgaa

SEQ ID NO: 3639 - DNA, 14 bp, synthetic construct
  source 1..14: mol_type = other DNA
taatccctgaaatg

SEQ ID NO: 3640 - DNA, 14 bp, synthetic construct
  source 1..14: mol_type = other DNA
ttgaccggctctcc

SEQ ID NO: 3641 - DNA, 14 bp, synthetic construct
  source 1..14: mol_type = other DNA
atgttcggtgaagc

SEQ ID NO: 3642 - DNA, 14 bp, synthetic construct
  source 1..14: mol_type = other DNA
ggagctaattccat

SEQ ID NO: 3643 - DNA, 14 bp, synthetic construct
  source 1..14: mol_type = other DNA
ctcttgtcccaggg

SEQ ID NO: 3644 - DNA, 14 bp, synthetic construct
  source 1..14: mol_type = other DNA
gccgcactttatga

SEQ ID NO: 3645 - DNA, 14 bp, synthetic construct
  source 1..14: mol_type = other DNA
ggaagttgcacgtt

SEQ ID NO: 3646 - DNA, 14 bp, synthetic construct
  source 1..14: mol_type = other DNA
ttacagagtaactc

SEQ ID NO: 3647 - DNA, 14 bp, synthetic construct
  source 1..14: mol_type = other DNA
ttggcaaaataatg

SEQ ID NO: 3648 - DNA, 14 bp, synthetic construct
  source 1..14: mol_type = other DNA
tgctggatgtcaaa

SEQ ID NO: 3649 - DNA, 14 bp, synthetic construct
  source 1..14: mol_type = other DNA
ttcttggcggggaa

SEQ ID NO: 3650 - DNA, 14 bp, synthetic construct
  source 1..14: mol_type = other DNA
ggtaacagatttag

SEQ ID NO: 3651 - DNA, 14 bp, synthetic construct
  source 1..14: mol_type = other DNA
acccgcttatccgt

SEQ ID NO: 3652 - DNA, 14 bp, synthetic construct
  source 1..14: mol_type = other DNA
cccattcaatgatc

SEQ ID NO: 3653 - DNA, 14 bp, synthetic construct
  source 1..14: mol_type = other DNA
tgtcctacctatcg

SEQ ID NO: 3654 - DNA, 14 bp, synthetic construct
  source 1..14: mol_type = other DNA
tctcgtataggact

SEQ ID NO: 3655 - DNA, 14 bp, synthetic construct
  source 1..14: mol_type = other DNA
ttcgcaggaattgt

SEQ ID NO: 3656 - DNA, 14 bp, synthetic construct
  source 1..14: mol_type = other DNA
ggtagatcgtatat

SEQ ID NO: 3657 - DNA, 14 bp, synthetic construct
  source 1..14: mol_type = other DNA
ttcaattcagccgt

SEQ ID NO: 3658 - DNA, 14 bp, synthetic construct
  source 1..14: mol_type = other DNA
gacttgtattccga

SEQ ID NO: 3659 - DNA, 14 bp, synthetic construct
  source 1..14: mol_type = other DNA
tctgtaggggtggt

SEQ ID NO: 3660 - DNA, 14 bp, synthetic construct
  source 1..14: mol_type = other DNA
cacgtatcactttg

SEQ ID NO: 3661 - DNA, 14 bp, synthetic construct
  source 1..14: mol_type = other DNA
atacataacctatt

SEQ ID NO: 3662 - DNA, 14 bp, synthetic construct
  source 1..14: mol_type = other DNA
accaaggatatttt

SEQ ID NO: 3663 - DNA, 14 bp, synthetic construct
  source 1..14: mol_type = other DNA
tttcaggtagatgg

SEQ ID NO: 3664 - DNA, 14 bp, synthetic construct
  source 1..14: mol_type = other DNA
tagtgtatgccggt

SEQ ID NO: 3665 - DNA, 14 bp, synthetic construct
  source 1..14: mol_type = other DNA
caggagtcggtttt

SEQ ID NO: 3666 - DNA, 14 bp, synthetic construct
  source 1..14: mol_type = other DNA
ttaaatgcctgctc

SEQ ID NO: 3667 - DNA, 14 bp, synthetic construct
  source 1..14: mol_type = other DNA
ttaaatccagattg

SEQ ID NO: 3668 - DNA, 14 bp, synthetic construct
  source 1..14: mol_type = other DNA
tcttcaataacgat

SEQ ID NO: 3669 - DNA, 14 bp, synthetic construct
  source 1..14: mol_type = other DNA
tataatggtcaagt

SEQ ID NO: 3670 - DNA, 14 bp, synthetic construct
  source 1..14: mol_type = other DNA
accgtcggtatttc

SEQ ID NO: 3671 - DNA, 14 bp, synthetic construct
  source 1..14: mol_type = other DNA
agagtactgtatta

SEQ ID NO: 3672 - DNA, 14 bp, synthetic construct
  source 1..14: mol_type = other DNA
gactatggtcctat

SEQ ID NO: 3673 - DNA, 14 bp, synthetic construct
  source 1..14: mol_type = other DNA
taaattcacagttg

SEQ ID NO: 3674 - DNA, 14 bp, synthetic construct
  source 1..14: mol_type = other DNA
aattatgccgctta

SEQ ID NO: 3675 - DNA, 14 bp, synthetic construct
  source 1..14: mol_type = other DNA
caagcattgctctt

SEQ ID NO: 3676 - DNA, 14 bp, synthetic construct
  source 1..14: mol_type = other DNA
tggtggagtgtctc

SEQ ID NO: 3677 - DNA, 14 bp, synthetic construct
  source 1..14: mol_type = other DNA
gtccggtcagcttt

SEQ ID NO: 3678 - DNA, 14 bp, synthetic construct
  source 1..14: mol_type = other DNA
tagtgacatcgatt

SEQ ID NO: 3679 - DNA, 14 bp, synthetic construct
  source 1..14: mol_type = other DNA
agattaggctaatt

SEQ ID NO: 3680 - DNA, 14 bp, synthetic construct
  source 1..14: mol_type = other DNA
ctcttctgtccaaa

SEQ ID NO: 3681 - DNA, 14 bp, synthetic construct
  source 1..14: mol_type = other DNA
ggtgtatgttagcc

SEQ ID NO: 3682 - DNA, 14 bp, synthetic construct
  source 1..14: mol_type = other DNA
cctcgaatttgcta

SEQ ID NO: 3683 - DNA, 14 bp, synthetic construct
  source 1..14: mol_type = other DNA
ccatttatgggtcc

SEQ ID NO: 3684 - DNA, 14 bp, synthetic construct
  source 1..14: mol_type = other DNA
gacgatttccttaa

SEQ ID NO: 3685 - DNA, 14 bp, synthetic construct
  source 1..14: mol_type = other DNA
tgtaccctagttag

SEQ ID NO: 3686 - DNA, 14 bp, synthetic construct
  source 1..14: mol_type = other DNA
gcttaccgatgtct

SEQ ID NO: 3687 - DNA, 14 bp, synthetic construct
  source 1..14: mol_type = other DNA
cattcatggtgact

SEQ ID NO: 3688 - DNA, 14 bp, synthetic construct
  source 1..14: mol_type = other DNA
gaaatgtggatgtt

SEQ ID NO: 3689 - DNA, 14 bp, synthetic construct
  source 1..14: mol_type = other DNA
tctaagtcatcctg

SEQ ID NO: 3690 - DNA, 14 bp, synthetic construct
  source 1..14: mol_type = other DNA
tgtatatgaactca

SEQ ID NO: 3691 - DNA, 14 bp, synthetic construct
  source 1..14: mol_type = other DNA
acttccggttccat

SEQ ID NO: 3692 - DNA, 14 bp, synthetic construct
  source 1..14: mol_type = other DNA
ttcactgatatcac

SEQ ID NO: 3693 - DNA, 14 bp, synthetic construct
  source 1..14: mol_type = other DNA
gttgtgagtgccta

SEQ ID NO: 3694 - DNA, 14 bp, synthetic construct
  source 1..14: mol_type = other DNA
gtaagcattgagtt

SEQ ID NO: 3695 - DNA, 14 bp, synthetic construct
  source 1..14: mol_type = other DNA
aagttatggattaa

SEQ ID NO: 3696 - DNA, 14 bp, synthetic construct
  source 1..14: mol_type = other DNA
cacctactttactg

SEQ ID NO: 3697 - DNA, 14 bp, synthetic construct
  source 1..14: mol_type = other DNA
aattactcttaggc

SEQ ID NO: 3698 - DNA, 14 bp, synthetic construct
  source 1..14: mol_type = other DNA
tgctacttgacctg

SEQ ID NO: 3699 - DNA, 14 bp, synthetic construct
  source 1..14: mol_type = other DNA
tgctatgctatgcc

SEQ ID NO: 3700 - DNA, 14 bp, synthetic construct
  source 1..14: mol_type = other DNA
taacgcttaacatt

SEQ ID NO: 3701 - DNA, 14 bp, synthetic construct
  source 1..14: mol_type = other DNA
tagggtatatatgc

SEQ ID NO: 3702 - DNA, 14 bp, synthetic construct
  source 1..14: mol_type = other DNA
atgactttaggtgg

SEQ ID NO: 3703 - DNA, 14 bp, synthetic construct
  source 1..14: mol_type = other DNA
gtcgcttaaggtgt

SEQ ID NO: 3704 - DNA, 14 bp, synthetic construct
  source 1..14: mol_type = other DNA
tcagacctatttgg

SEQ ID NO: 3705 - DNA, 14 bp, synthetic construct
  source 1..14: mol_type = other DNA
ctttaagctgaaat

SEQ ID NO: 3706 - DNA, 14 bp, synthetic construct
  source 1..14: mol_type = other DNA
gtctcttgagtccg

SEQ ID NO: 3707 - DNA, 14 bp, synthetic construct
  source 1..14: mol_type = other DNA
tgccgcttgcatct

SEQ ID NO: 3708 - DNA, 14 bp, synthetic construct
  source 1..14: mol_type = other DNA
aattctattcacag

SEQ ID NO: 3709 - DNA, 14 bp, synthetic construct
  source 1..14: mol_type = other DNA
gttcggactatgtg

SEQ ID NO: 3710 - DNA, 14 bp, synthetic construct
  source 1..14: mol_type = other DNA
tcctttaaatcaag

SEQ ID NO: 3711 - DNA, 14 bp, synthetic construct
  source 1..14: mol_type = other DNA
atctaggattccta

SEQ ID NO: 3712 - DNA, 14 bp, synthetic construct
  source 1..14: mol_type = other DNA
tggaccttttgagg

SEQ ID NO: 3713 - DNA, 14 bp, synthetic construct
  source 1..14: mol_type = other DNA
tgcattcgtatccg

SEQ ID NO: 3714 - DNA, 14 bp, synthetic construct
  source 1..14: mol_type = other DNA
tatgcctgtactac

SEQ ID NO: 3715 - DNA, 14 bp, synthetic construct
  source 1..14: mol_type = other DNA
ctgtgaatactatg

SEQ ID NO: 3716 - DNA, 14 bp, synthetic construct
  source 1..14: mol_type = other DNA
agtaatcatttgaa

SEQ ID NO: 3717 - DNA, 14 bp, synthetic construct
  source 1..14: mol_type = other DNA
ggctctcgttactg

SEQ ID NO: 3718 - DNA, 14 bp, synthetic construct
  source 1..14: mol_type = other DNA
tatccctcctctca

SEQ ID NO: 3719 - DNA, 14 bp, synthetic construct
  source 1..14: mol_type = other DNA
tgtgtccgcgtagt

SEQ ID NO: 3720 - DNA, 14 bp, synthetic construct
  source 1..14: mol_type = other DNA
catctcacgttgtg

SEQ ID NO: 3721 - DNA, 14 bp, synthetic construct
  source 1..14: mol_type = other DNA
ttacgaaatttcca

SEQ ID NO: 3722 - DNA, 14 bp, synthetic construct
  source 1..14: mol_type = other DNA
agttaggaggtatt

SEQ ID NO: 3723 - DNA, 14 bp, synthetic construct
  source 1..14: mol_type = other DNA
gtcttccctaaaat

SEQ ID NO: 3724 - DNA, 14 bp, synthetic construct
  source 1..14: mol_type = other DNA
tcgttgccacgtct

SEQ ID NO: 3725 - DNA, 14 bp, synthetic construct
  source 1..14: mol_type = other DNA
tctctgccctggta

SEQ ID NO: 3726 - DNA, 14 bp, synthetic construct
  source 1..14: mol_type = other DNA
ctttaccaaattga

SEQ ID NO: 3727 - DNA, 14 bp, synthetic construct
  source 1..14: mol_type = other DNA
atcgtttccccctc

SEQ ID NO: 3728 - DNA, 14 bp, synthetic construct
  source 1..14: mol_type = other DNA
ggactattaagtat

SEQ ID NO: 3729 - DNA, 14 bp, synthetic construct
  source 1..14: mol_type = other DNA
ctaaccgtcgtatt

SEQ ID NO: 3730 - DNA, 14 bp, synthetic construct
  source 1..14: mol_type = other DNA
cgatagttagtgta

SEQ ID NO: 3731 - DNA, 14 bp, synthetic construct
  source 1..14: mol_type = other DNA
ctcccgttaaattc

SEQ ID NO: 3732 - DNA, 14 bp, synthetic construct
  source 1..14: mol_type = other DNA
ttaacctccgatta

SEQ ID NO: 3733 - DNA, 14 bp, synthetic construct
  source 1..14: mol_type = other DNA
cctaactgtttgac

SEQ ID NO: 3734 - DNA, 14 bp, synthetic construct
  source 1..14: mol_type = other DNA
attgcgtacctgta

SEQ ID NO: 3735 - DNA, 14 bp, synthetic construct
  source 1..14: mol_type = other DNA
cctctgtgtgatcg

SEQ ID NO: 3736 - DNA, 14 bp, synthetic construct
  source 1..14: mol_type = other DNA
ctcccattgtgatc

SEQ ID NO: 3737 - DNA, 14 bp, synthetic construct
  source 1..14: mol_type = other DNA
tgccacttagtagt

SEQ ID NO: 3738 - DNA, 14 bp, synthetic construct
  source 1..14: mol_type = other DNA
aaatcaatttgctg

SEQ ID NO: 3739 - DNA, 14 bp, synthetic construct
  source 1..14: mol_type = other DNA
gcggctttcttgcc

SEQ ID NO: 3740 - DNA, 14 bp, synthetic construct
  source 1..14: mol_type = other DNA
tctccgttgagcgt

SEQ ID NO: 3741 - DNA, 14 bp, synthetic construct
  source 1..14: mol_type = other DNA
acttgcctagtggt

SEQ ID NO: 3742 - DNA, 14 bp, synthetic construct
  source 1..14: mol_type = other DNA
tctcaagtactggt

SEQ ID NO: 3743 - DNA, 14 bp, synthetic construct
  source 1..14: mol_type = other DNA
aatcagttcgtatc

SEQ ID NO: 3744 - DNA, 14 bp, synthetic construct
  source 1..14: mol_type = other DNA
ttacaagtgttcaa

SEQ ID NO: 3745 - DNA, 14 bp, synthetic construct
  source 1..14: mol_type = other DNA
tttcccgatgtcga

SEQ ID NO: 3746 - DNA, 14 bp, synthetic construct
  source 1..14: mol_type = other DNA
tcctcgcaacattt

SEQ ID NO: 3747 - DNA, 14 bp, synthetic construct
  source 1..14: mol_type = other DNA
aacatgttactagt

SEQ ID NO: 3748 - DNA, 14 bp, synthetic construct
  source 1..14: mol_type = other DNA
ttagtggaattaaa

SEQ ID NO: 3749 - DNA, 14 bp, synthetic construct
  source 1..14: mol_type = other DNA
gtattacttgccca

SEQ ID NO: 3750 - DNA, 14 bp, synthetic construct
  source 1..14: mol_type = other DNA
tctatctgccagat

SEQ ID NO: 3751 - DNA, 14 bp, synthetic construct
  source 1..14: mol_type = other DNA
accgattggtgtct

SEQ ID NO: 3752 - DNA, 14 bp, synthetic construct
  source 1..14: mol_type = other DNA
ttacatccgtataa

SEQ ID NO: 3753 - DNA, 14 bp, synthetic construct
  source 1..14: mol_type = other DNA
tttgtgcccgatgg

SEQ ID NO: 3754 - DNA, 14 bp, synthetic construct
  source 1..14: mol_type = other DNA
gtaattcgtcagct

SEQ ID NO: 3755 - DNA, 14 bp, synthetic construct
  source 1..14: mol_type = other DNA
cggctctgcctgtt

SEQ ID NO: 3756 - DNA, 14 bp, synthetic construct
  source 1..14: mol_type = other DNA
atggtgtgagtatc

SEQ ID NO: 3757 - DNA, 14 bp, synthetic construct
  source 1..14: mol_type = other DNA
ggttctcatccatc

SEQ ID NO: 3758 - DNA, 14 bp, synthetic construct
  source 1..14: mol_type = other DNA
atcgactacgttta

SEQ ID NO: 3759 - DNA, 14 bp, synthetic construct
  source 1..14: mol_type = other DNA
agatcttatggtgc

SEQ ID NO: 3760 - DNA, 14 bp, synthetic construct
  source 1..14: mol_type = other DNA
ttactcagccggtt

SEQ ID NO: 3761 - DNA, 14 bp, synthetic construct
  source 1..14: mol_type = other DNA
gcagtatcaatttc

SEQ ID NO: 3762 - DNA, 14 bp, synthetic construct
  source 1..14: mol_type = other DNA
gtgtaattccagtc

SEQ ID NO: 3763 - DNA, 14 bp, synthetic construct
  source 1..14: mol_type = other DNA
agtcgatctttcaa

SEQ ID NO: 3764 - DNA, 14 bp, synthetic construct
  source 1..14: mol_type = other DNA
taaccctagtctat

SEQ ID NO: 3765 - DNA, 14 bp, synthetic construct
  source 1..14: mol_type = other DNA
tgtatacgttcggc

SEQ ID NO: 3766 - DNA, 14 bp, synthetic construct
  source 1..14: mol_type = other DNA
gcatactagtcatt

SEQ ID NO: 3767 - DNA, 14 bp, synthetic construct
  source 1..14: mol_type = other DNA
gtcttaccaccttc

SEQ ID NO: 3768 - DNA, 14 bp, synthetic construct
  source 1..14: mol_type = other DNA
cttcgacgtagttg

SEQ ID NO: 3769 - DNA, 14 bp, synthetic construct
  source 1..14: mol_type = other DNA
ctcgcccattttca

SEQ ID NO: 3770 - DNA, 14 bp, synthetic construct
  source 1..14: mol_type = other DNA
tactatctccccat

SEQ ID NO: 3771 - DNA, 14 bp, synthetic construct
  source 1..14: mol_type = other DNA
ctccccgttatgct

SEQ ID NO: 3772 - DNA, 14 bp, synthetic construct
  source 1..14: mol_type = other DNA
tttcgacgctcggt

SEQ ID NO: 3773 - DNA, 14 bp, synthetic construct
  source 1..14: mol_type = other DNA
cattataatagcat

SEQ ID NO: 3774 - DNA, 14 bp, synthetic construct
  source 1..14: mol_type = other DNA
aatgggtgtgattg

SEQ ID NO: 3775 - DNA, 14 bp, synthetic construct
  source 1..14: mol_type = other DNA
tcagctatcataat

SEQ ID NO: 3776 - DNA, 14 bp, synthetic construct
  source 1..14: mol_type = other DNA
gcgatgttaatctc

SEQ ID NO: 3777 - DNA, 14 bp, synthetic construct
  source 1..14: mol_type = other DNA
tgtccagtctggta

SEQ ID NO: 3778 - DNA, 14 bp, synthetic construct
  source 1..14: mol_type = other DNA
ggctattgatctag

SEQ ID NO: 3779 - DNA, 14 bp, synthetic construct
  source 1..14: mol_type = other DNA
actaactattgtga

SEQ ID NO: 3780 - DNA, 14 bp, synthetic construct
  source 1..14: mol_type = other DNA
tcggataaattact

SEQ ID NO: 3781 - DNA, 14 bp, synthetic construct
  source 1..14: mol_type = other DNA
taagcttctcggct

SEQ ID NO: 3782 - DNA, 14 bp, synthetic construct
  source 1..14: mol_type = other DNA
tgatccgattcgtc

SEQ ID NO: 3783 - DNA, 14 bp, synthetic construct
  source 1..14: mol_type = other DNA
tttggcgttgagca

SEQ ID NO: 3784 - DNA, 14 bp, synthetic construct
  source 1..14: mol_type = other DNA
gggttccgattaat

SEQ ID NO: 3785 - DNA, 14 bp, synthetic construct
  source 1..14: mol_type = other DNA
ttcagctttaagcc

SEQ ID NO: 3786 - DNA, 14 bp, synthetic construct
  source 1..14: mol_type = other DNA
atttggagctaact

SEQ ID NO: 3787 - DNA, 14 bp, synthetic construct
  source 1..14: mol_type = other DNA
gggctttcctctag

SEQ ID NO: 3788 - DNA, 14 bp, synthetic construct
  source 1..14: mol_type = other DNA
ttcgtactcactcg

SEQ ID NO: 3789 - DNA, 14 bp, synthetic construct
  source 1..14: mol_type = other DNA
gattagtttagaag

SEQ ID NO: 3790 - DNA, 14 bp, synthetic construct
  source 1..14: mol_type = other DNA
tgctcggttatcag

SEQ ID NO: 3791 - DNA, 14 bp, synthetic construct
  source 1..14: mol_type = other DNA
tacgaccatttcgt

SEQ ID NO: 3792 - DNA, 14 bp, synthetic construct
  source 1..14: mol_type = other DNA
tgggatcatatgtc

SEQ ID NO: 3793 - DNA, 14 bp, synthetic construct
  source 1..14: mol_type = other DNA
cttatgctgaaggt

SEQ ID NO: 3794 - DNA, 14 bp, synthetic construct
  source 1..14: mol_type = other DNA
tgtgaccttacgct

SEQ ID NO: 3795 - DNA, 14 bp, synthetic construct
  source 1..14: mol_type = other DNA
gttgtttagaacac

SEQ ID NO: 3796 - DNA, 14 bp, synthetic construct
  source 1..14: mol_type = other DNA
caagactttatctc

SEQ ID NO: 3797 - DNA, 14 bp, synthetic construct
  source 1..14: mol_type = other DNA
ctttggctccctca

SEQ ID NO: 3798 - DNA, 14 bp, synthetic construct
  source 1..14: mol_type = other DNA
tttatatggcagcg

SEQ ID NO: 3799 - DNA, 14 bp, synthetic construct
  source 1..14: mol_type = other DNA
tggtcccttgatgc

SEQ ID NO: 3800 - DNA, 14 bp, synthetic construct
  source 1..14: mol_type = other DNA
atagtctggtgtca

SEQ ID NO: 3801 - DNA, 14 bp, synthetic construct
  source 1..14: mol_type = other DNA
gccacctattttag

SEQ ID NO: 3802 - DNA, 14 bp, synthetic construct
  source 1..14: mol_type = other DNA
actctgcattgcat

SEQ ID NO: 3803 - DNA, 14 bp, synthetic construct
  source 1..14: mol_type = other DNA
cctctgattcatgc

SEQ ID NO: 3804 - DNA, 14 bp, synthetic construct
  source 1..14: mol_type = other DNA
atggtgtcttgccc

SEQ ID NO: 3805 - DNA, 14 bp, synthetic construct
  source 1..14: mol_type = other DNA
cagattttaggcat

SEQ ID NO: 3806 - DNA, 14 bp, synthetic construct
  source 1..14: mol_type = other DNA
catttcgtaatccg

SEQ ID NO: 3807 - DNA, 14 bp, synthetic construct
  source 1..14: mol_type = other DNA
cctcgcttatcatg

SEQ ID NO: 3808 - DNA, 14 bp, synthetic construct
  source 1..14: mol_type = other DNA
tcaatttgcaatgg

SEQ ID NO: 3809 - DNA, 14 bp, synthetic construct
  source 1..14: mol_type = other DNA
tgtatgtagtaccc

SEQ ID NO: 3810 - DNA, 14 bp, synthetic construct
  source 1..14: mol_type = other DNA
ctacgtaacacttt

SEQ ID NO: 3811 - DNA, 14 bp, synthetic construct
  source 1..14: mol_type = other DNA
ggctcgtttggtcc

SEQ ID NO: 3812 - DNA, 14 bp, synthetic construct
  source 1..14: mol_type = other DNA
tgttttcaaaaggc

SEQ ID NO: 3813 - DNA, 14 bp, synthetic construct
  source 1..14: mol_type = other DNA
atccttgtagtaag

SEQ ID NO: 3814 - DNA, 14 bp, synthetic construct
  source 1..14: mol_type = other DNA
caatgctgtccgtt

SEQ ID NO: 3815 - DNA, 14 bp, synthetic construct
  source 1..14: mol_type = other DNA
ctcgctctgtaaat

SEQ ID NO: 3816 - DNA, 14 bp, synthetic construct
  source 1..14: mol_type = other DNA
gtggtttggcccgt

SEQ ID NO: 3817 - DNA, 14 bp, synthetic construct
  source 1..14: mol_type = other DNA
tttcgctgctaccc

SEQ ID NO: 3818 - DNA, 14 bp, synthetic construct
  source 1..14: mol_type = other DNA
cccttggttagggt

SEQ ID NO: 3819 - DNA, 14 bp, synthetic construct
  source 1..14: mol_type = other DNA
ttcataggataatc

SEQ ID NO: 3820 - DNA, 14 bp, synthetic construct
  source 1..14: mol_type = other DNA
taacttgttaccac

SEQ ID NO: 3821 - DNA, 14 bp, synthetic construct
  source 1..14: mol_type = other DNA
tgctgtaactgtaa

SEQ ID NO: 3822 - DNA, 14 bp, synthetic construct
  source 1..14: mol_type = other DNA
caaccctctgttgt

SEQ ID NO: 3823 - DNA, 14 bp, synthetic construct
  source 1..14: mol_type = other DNA
cctcgatgttcgct

SEQ ID NO: 3824 - DNA, 14 bp, synthetic construct
  source 1..14: mol_type = other DNA
tccgtttaccaggt

SEQ ID NO: 3825 - DNA, 14 bp, synthetic construct
  source 1..14: mol_type = other DNA
gggtcttctcgcta

SEQ ID NO: 3826 - DNA, 14 bp, synthetic construct
  source 1..14: mol_type = other DNA
gtgttcactgggat

SEQ ID NO: 3827 - DNA, 14 bp, synthetic construct
  source 1..14: mol_type = other DNA
cgtcggattctatg

SEQ ID NO: 3828 - DNA, 14 bp, synthetic construct
  source 1..14: mol_type = other DNA
ttagcttcccagtg

SEQ ID NO: 3829 - DNA, 14 bp, synthetic construct
  source 1..14: mol_type = other DNA
ataagatgtgcgtt

SEQ ID NO: 3830 - DNA, 14 bp, synthetic construct
  source 1..14: mol_type = other DNA
gcgtgttgcatatc

SEQ ID NO: 3831 - DNA, 14 bp, synthetic construct
  source 1..14: mol_type = other DNA
acgcttggtgcctt

SEQ ID NO: 3832 - DNA, 14 bp, synthetic construct
  source 1..14: mol_type = other DNA
cagtaattgttacg

SEQ ID NO: 3833 - DNA, 14 bp, synthetic construct
  source 1..14: mol_type = other DNA
cgagaaatttgctt

SEQ ID NO: 3834 - DNA, 14 bp, synthetic construct
  source 1..14: mol_type = other DNA
ttatagcgttcaag

SEQ ID NO: 3835 - DNA, 14 bp, synthetic construct
  source 1..14: mol_type = other DNA
gcttaaatgcttca

SEQ ID NO: 3836 - DNA, 14 bp, synthetic construct
  source 1..14: mol_type = other DNA
tgattactgaggta

SEQ ID NO: 3837 - DNA, 14 bp, synthetic construct
  source 1..14: mol_type = other DNA
gcaatattgccgtt

SEQ ID NO: 3838 - DNA, 14 bp, synthetic construct
  source 1..14: mol_type = other DNA
ttcggtaggttgac

SEQ ID NO: 3839 - DNA, 14 bp, synthetic construct
  source 1..14: mol_type = other DNA
tcccctgggttcct

SEQ ID NO: 3840 - DNA, 14 bp, synthetic construct
  source 1..14: mol_type = other DNA
ttcgaaatatagat

SEQ ID NO: 3841 - DNA, 14 bp, synthetic construct
  source 1..14: mol_type = other DNA
cgtatattgataac

SEQ ID NO: 3842 - DNA, 14 bp, synthetic construct
  source 1..14: mol_type = other DNA
actacccggtttta

SEQ ID NO: 3843 - DNA, 14 bp, synthetic construct
  source 1..14: mol_type = other DNA
tcttaacttcgagc

SEQ ID NO: 3844 - DNA, 14 bp, synthetic construct
  source 1..14: mol_type = other DNA
ggcttgattaatca

SEQ ID NO: 3845 - DNA, 14 bp, synthetic construct
  source 1..14: mol_type = other DNA
aagggtccactttt

SEQ ID NO: 3846 - DNA, 14 bp, synthetic construct
  source 1..14: mol_type = other DNA
gtaataatgtagtc

SEQ ID NO: 3847 - DNA, 14 bp, synthetic construct
  source 1..14: mol_type = other DNA
aatttgtcagatcg

SEQ ID NO: 3848 - DNA, 14 bp, synthetic construct
  source 1..14: mol_type = other DNA
ttttaaggtggccg

SEQ ID NO: 3849 - DNA, 14 bp, synthetic construct
  source 1..14: mol_type = other DNA
ttttcgcacgtgac

SEQ ID NO: 3850 - DNA, 14 bp, synthetic construct
  source 1..14: mol_type = other DNA
ggagttatagttga

SEQ ID NO: 3851 - DNA, 14 bp, synthetic construct
  source 1..14: mol_type = other DNA
tttacaagtatcca

SEQ ID NO: 3852 - DNA, 14 bp, synthetic construct
  source 1..14: mol_type = other DNA
cggttccaactctt

SEQ ID NO: 3853 - DNA, 14 bp, synthetic construct
  source 1..14: mol_type = other DNA
aggtgtctcatata

SEQ ID NO: 3854 - DNA, 14 bp, synthetic construct
  source 1..14: mol_type = other DNA
tacactctatgaat

SEQ ID NO: 3855 - DNA, 14 bp, synthetic construct
  source 1..14: mol_type = other DNA
gggccattaatttc

SEQ ID NO: 3856 - DNA, 14 bp, synthetic construct
  source 1..14: mol_type = other DNA
gtttccatactcac

SEQ ID NO: 3857 - DNA, 14 bp, synthetic construct
  source 1..14: mol_type = other DNA
gttgatctacaact

SEQ ID NO: 3858 - DNA, 14 bp, synthetic construct
  source 1..14: mol_type = other DNA
gacgaatgttctta

SEQ ID NO: 3859 - DNA, 14 bp, synthetic construct
  source 1..14: mol_type = other DNA
tcctaccttaatcg

SEQ ID NO: 3860 - DNA, 14 bp, synthetic construct
  source 1..14: mol_type = other DNA
tagggtgattacct

SEQ ID NO: 3861 - DNA, 14 bp, synthetic construct
  source 1..14: mol_type = other DNA
atggaatggtattg

SEQ ID NO: 3862 - DNA, 14 bp, synthetic construct
  source 1..14: mol_type = other DNA
ccatttacctccgt

SEQ ID NO: 3863 - DNA, 14 bp, synthetic construct
  source 1..14: mol_type = other DNA
tatgctattggaag

SEQ ID NO: 3864 - DNA, 14 bp, synthetic construct
  source 1..14: mol_type = other DNA
cgtggttggacctt

SEQ ID NO: 3865 - DNA, 14 bp, synthetic construct
  source 1..14: mol_type = other DNA
atactctaaaggtt

SEQ ID NO: 3866 - DNA, 14 bp, synthetic construct
  source 1..14: mol_type = other DNA
actatgggggtctt

SEQ ID NO: 3867 - DNA, 14 bp, synthetic construct
  source 1..14: mol_type = other DNA
gattactccgtagt

SEQ ID NO: 3868 - DNA, 14 bp, synthetic construct
  source 1..14: mol_type = other DNA
agtgtctcgctaat

SEQ ID NO: 3869 - DNA, 14 bp, synthetic construct
  source 1..14: mol_type = other DNA
atgcttatagatga

SEQ ID NO: 3870 - DNA, 14 bp, synthetic construct
  source 1..14: mol_type = other DNA
ggttgcgcagcttt

SEQ ID NO: 3871 - DNA, 14 bp, synthetic construct
  source 1..14: mol_type = other DNA
ccaatgttcaatct

SEQ ID NO: 3872 - DNA, 14 bp, synthetic construct
  source 1..14: mol_type = other DNA
gaagacttttccat

SEQ ID NO: 3873 - DNA, 14 bp, synthetic construct
  source 1..14: mol_type = other DNA
tgtgtacgggcttg

SEQ ID NO: 3874 - DNA, 14 bp, synthetic construct
  source 1..14: mol_type = other DNA
acctattagtctaa

SEQ ID NO: 3875 - DNA, 14 bp, synthetic construct
  source 1..14: mol_type = other DNA
aactcatctttcga

SEQ ID NO: 3876 - DNA, 14 bp, synthetic construct
  source 1..14: mol_type = other DNA
tatgtatcctgggc

SEQ ID NO: 3877 - DNA, 14 bp, synthetic construct
  source 1..14: mol_type = other DNA
agagcttagaattt

SEQ ID NO: 3878 - DNA, 14 bp, synthetic construct
  source 1..14: mol_type = other DNA
ttagtagctatagc

SEQ ID NO: 3879 - DNA, 14 bp, synthetic construct
  source 1..14: mol_type = other DNA
agtcggttcaatgt

SEQ ID NO: 3880 - DNA, 14 bp, synthetic construct
  source 1..14: mol_type = other DNA
cgccctatgtttcg

SEQ ID NO: 3881 - DNA, 14 bp, synthetic construct
  source 1..14: mol_type = other DNA
gttacgaaagttat

SEQ ID NO: 3882 - DNA, 14 bp, synthetic construct
  source 1..14: mol_type = other DNA
ctgcttgtatcgca

SEQ ID NO: 3883 - DNA, 14 bp, synthetic construct
  source 1..14: mol_type = other DNA
atcgagagctttct

SEQ ID NO: 3884 - DNA, 14 bp, synthetic construct
  source 1..14: mol_type = other DNA
ttgatcgtcacatg

SEQ ID NO: 3885 - DNA, 14 bp, synthetic construct
  source 1..14: mol_type = other DNA
tcaatgtctcaatg

SEQ ID NO: 3886 - DNA, 14 bp, synthetic construct
  source 1..14: mol_type = other DNA
gttgatgtgtggcg

SEQ ID NO: 3887 - DNA, 14 bp, synthetic construct
  source 1..14: mol_type = other DNA
atagcttcttacag

SEQ ID NO: 3888 - DNA, 14 bp, synthetic construct
  source 1..14: mol_type = other DNA
tctaatctgtaaaa

SEQ ID NO: 3889 - DNA, 14 bp, synthetic construct
  source 1..14: mol_type = other DNA
tgggggtctattca

SEQ ID NO: 3890 - DNA, 14 bp, synthetic construct
  source 1..14: mol_type = other DNA
tgcctggtatctag

SEQ ID NO: 3891 - DNA, 14 bp, synthetic construct
  source 1..14: mol_type = other DNA
catctagtatgtga

SEQ ID NO: 3892 - DNA, 14 bp, synthetic construct
  source 1..14: mol_type = other DNA
tgctatgtaataga

SEQ ID NO: 3893 - DNA, 14 bp, synthetic construct
  source 1..14: mol_type = other DNA
cactaagtcattat

SEQ ID NO: 3894 - DNA, 14 bp, synthetic construct
  source 1..14: mol_type = other DNA
ttcaacgctacctt

SEQ ID NO: 3895 - DNA, 14 bp, synthetic construct
  source 1..14: mol_type = other DNA
cctattaagtgtac

SEQ ID NO: 3896 - DNA, 14 bp, synthetic construct
  source 1..14: mol_type = other DNA
atgggtctccttac

SEQ ID NO: 3897 - DNA, 14 bp, synthetic construct
  source 1..14: mol_type = other DNA
ttgcacacgcttct

SEQ ID NO: 3898 - DNA, 14 bp, synthetic construct
  source 1..14: mol_type = other DNA
tggtgctaaatcta

SEQ ID NO: 3899 - DNA, 14 bp, synthetic construct
  source 1..14: mol_type = other DNA
acttgcactgattg

SEQ ID NO: 3900 - DNA, 14 bp, synthetic construct
  source 1..14: mol_type = other DNA
ggttttgaatacga

SEQ ID NO: 3901 - DNA, 14 bp, synthetic construct
  source 1..14: mol_type = other DNA
ttggctatcgccat

SEQ ID NO: 3902 - DNA, 14 bp, synthetic construct
  source 1..14: mol_type = other DNA
tgttagataagaat

SEQ ID NO: 3903 - DNA, 14 bp, synthetic construct
  source 1..14: mol_type = other DNA
taatcactgatgct

SEQ ID NO: 3904 - DNA, 14 bp, synthetic construct
  source 1..14: mol_type = other DNA
tgtttacgaaaata

SEQ ID NO: 3905 - DNA, 14 bp, synthetic construct
  source 1..14: mol_type = other DNA
tggtaataagtcgt

SEQ ID NO: 3906 - DNA, 14 bp, synthetic construct
  source 1..14: mol_type = other DNA
tgtagatgtctacg

SEQ ID NO: 3907 - DNA, 14 bp, synthetic construct
  source 1..14: mol_type = other DNA
ttgctacttaagcc

SEQ ID NO: 3908 - DNA, 14 bp, synthetic construct
  source 1..14: mol_type = other DNA
cgacttcctttcac

SEQ ID NO: 3909 - DNA, 14 bp, synthetic construct
  source 1..14: mol_type = other DNA
tagcctttatcgcc

SEQ ID NO: 3910 - DNA, 14 bp, synthetic construct
  source 1..14: mol_type = other DNA
actaagctttgtcg

SEQ ID NO: 3911 - DNA, 14 bp, synthetic construct
  source 1..14: mol_type = other DNA
ttcaatggccattt

SEQ ID NO: 3912 - DNA, 14 bp, synthetic construct
  source 1..14: mol_type = other DNA
ttcttacccttacc

SEQ ID NO: 3913 - DNA, 14 bp, synthetic construct
  source 1..14: mol_type = other DNA
gttattctaatggc

SEQ ID NO: 3914 - DNA, 14 bp, synthetic construct
  source 1..14: mol_type = other DNA
ttctttcaccgtgg

SEQ ID NO: 3915 - DNA, 14 bp, synthetic construct
  source 1..14: mol_type = other DNA
ggttccttaagtct

SEQ ID NO: 3916 - DNA, 14 bp, synthetic construct
  source 1..14: mol_type = other DNA
cttcagatatgtta

SEQ ID NO: 3917 - DNA, 14 bp, synthetic construct
  source 1..14: mol_type = other DNA
ttacttaggtccat

SEQ ID NO: 3918 - DNA, 14 bp, synthetic construct
  source 1..14: mol_type = other DNA
cgtcttgtcctata

SEQ ID NO: 3919 - DNA, 14 bp, synthetic construct
  source 1..14: mol_type = other DNA
tggaagttgtttca

SEQ ID NO: 3920 - DNA, 14 bp, synthetic construct
  source 1..14: mol_type = other DNA
actttagctcgtat

SEQ ID NO: 3921 - DNA, 14 bp, synthetic construct
  source 1..14: mol_type = other DNA
actagagtttattc

SEQ ID NO: 3922 - DNA, 14 bp, synthetic construct
  source 1..14: mol_type = other DNA
gcagttgtgtgatt

SEQ ID NO: 3923 - DNA, 14 bp, synthetic construct
  source 1..14: mol_type = other DNA
gttttatgccacct

SEQ ID NO: 3924 - DNA, 14 bp, synthetic construct
  source 1..14: mol_type = other DNA
atgagattcgattt

SEQ ID NO: 3925 - DNA, 14 bp, synthetic construct
  source 1..14: mol_type = other DNA
tgcacactttatat

SEQ ID NO: 3926 - DNA, 14 bp, synthetic construct
  source 1..14: mol_type = other DNA
ctatgatctgtact

SEQ ID NO: 3927 - DNA, 14 bp, synthetic construct
  source 1..14: mol_type = other DNA
cgcttagttgtcgt

SEQ ID NO: 3928 - DNA, 14 bp, synthetic construct
  source 1..14: mol_type = other DNA
ttttattagcgcga

SEQ ID NO: 3929 - DNA, 14 bp, synthetic construct
  source 1..14: mol_type = other DNA
atccgttcttccat

SEQ ID NO: 3930 - DNA, 14 bp, synthetic construct
  source 1..14: mol_type = other DNA
tcctgccgatttgt

SEQ ID NO: 3931 - DNA, 14 bp, synthetic construct
  source 1..14: mol_type = other DNA
tatcgctagctctt

SEQ ID NO: 3932 - DNA, 14 bp, synthetic construct
  source 1..14: mol_type = other DNA
cgatccttatctta

SEQ ID NO: 3933 - DNA, 14 bp, synthetic construct
  source 1..14: mol_type = other DNA
actataaatccttt

SEQ ID NO: 3934 - DNA, 14 bp, synthetic construct
  source 1..14: mol_type = other DNA
atatgtaaggtgtt

SEQ ID NO: 3935 - DNA, 14 bp, synthetic construct
  source 1..14: mol_type = other DNA
ggtctggctcttct

SEQ ID NO: 3936 - DNA, 14 bp, synthetic construct
  source 1..14: mol_type = other DNA
tttgatcagtaatg

SEQ ID NO: 3937 - DNA, 14 bp, synthetic construct
  source 1..14: mol_type = other DNA
tagattggtatata

SEQ ID NO: 3938 - DNA, 14 bp, synthetic construct
  source 1..14: mol_type = other DNA
ctgttacatgtcta

SEQ ID NO: 3939 - DNA, 14 bp, synthetic construct
  source 1..14: mol_type = other DNA
taatcttacttggc

SEQ ID NO: 3940 - DNA, 14 bp, synthetic construct
  source 1..14: mol_type = other DNA
cccctctatttatc

SEQ ID NO: 3941 - DNA, 14 bp, synthetic construct
  source 1..14: mol_type = other DNA
tcgtattgttacac

SEQ ID NO: 3942 - DNA, 14 bp, synthetic construct
  source 1..14: mol_type = other DNA
tcattcgatctcgt

SEQ ID NO: 3943 - DNA, 14 bp, synthetic construct
  source 1..14: mol_type = other DNA
agatctgactttat

SEQ ID NO: 3944 - DNA, 14 bp, synthetic construct
  source 1..14: mol_type = other DNA
agtttgtttgaaac

SEQ ID NO: 3945 - DNA, 14 bp, synthetic construct
  source 1..14: mol_type = other DNA
aagtgtgcttcatt

SEQ ID NO: 3946 - DNA, 14 bp, synthetic construct
  source 1..14: mol_type = other DNA
ttcctgttatcaga

SEQ ID NO: 3947 - DNA, 14 bp, synthetic construct
  source 1..14: mol_type = other DNA
ctttgccctgttca

SEQ ID NO: 3948 - DNA, 14 bp, synthetic construct
  source 1..14: mol_type = other DNA
gctagtgctctctt

SEQ ID NO: 3949 - DNA, 14 bp, synthetic construct
  source 1..14: mol_type = other DNA
ctgctggttaagtt

SEQ ID NO: 3950 - DNA, 14 bp, synthetic construct
  source 1..14: mol_type = other DNA
actgcatttttgag

SEQ ID NO: 3951 - DNA, 14 bp, synthetic construct
  source 1..14: mol_type = other DNA
atgatgttggttac

SEQ ID NO: 3952 - DNA, 14 bp, synthetic construct
  source 1..14: mol_type = other DNA
acactttatactta

SEQ ID NO: 3953 - DNA, 14 bp, synthetic construct
  source 1..14: mol_type = other DNA
atgtttctaaagtg

SEQ ID NO: 3954 - DNA, 14 bp, synthetic construct
  source 1..14: mol_type = other DNA
tgtgttgacatctc

SEQ ID NO: 3955 - DNA, 14 bp, synthetic construct
  source 1..14: mol_type = other DNA
tgttatatagctcc

SEQ ID NO: 3956 - DNA, 14 bp, synthetic construct
  source 1..14: mol_type = other DNA
acttaagtctttga

SEQ ID NO: 3957 - DNA, 14 bp, synthetic construct
  source 1..14: mol_type = other DNA
gctgtctggatatt

SEQ ID NO: 3958 - DNA, 14 bp, synthetic construct
  source 1..14: mol_type = other DNA
ctgttaatcaggtt

SEQ ID NO: 3959 - DNA, 14 bp, synthetic construct
  source 1..14: mol_type = other DNA
aaatcttcctgatt

SEQ ID NO: 3960 - DNA, 14 bp, synthetic construct
  source 1..14: mol_type = other DNA
gtaaagtggtgttt

SEQ ID NO: 3961 - DNA, 14 bp, synthetic construct
  source 1..14: mol_type = other DNA
tatcatcctgtgat

SEQ ID NO: 3962 - DNA, 14 bp, synthetic construct
  source 1..14: mol_type = other DNA
cttagtgcctttac

SEQ ID NO: 3963 - DNA, 14 bp, synthetic construct
  source 1..14: mol_type = other DNA
agttctctatatac

SEQ ID NO: 3964 - DNA, 14 bp, synthetic construct
  source 1..14: mol_type = other DNA
ggctaatttttgca

SEQ ID NO: 3965 - DNA, 14 bp, synthetic construct
  source 1..14: mol_type = other DNA
attggccgtcttat

SEQ ID NO: 3966 - DNA, 14 bp, synthetic construct
  source 1..14: mol_type = other DNA
tctccttcttccga

SEQ ID NO: 3967 - DNA, 14 bp, synthetic construct
  source 1..14: mol_type = other DNA
cttttcaggcactt

SEQ ID NO: 3968 - DNA, 14 bp, synthetic construct
  source 1..14: mol_type = other DNA
gtggtttaattgcg

SEQ ID NO: 3969 - DNA, 14 bp, synthetic construct
  source 1..14: mol_type = other DNA
agtgattacttcct

SEQ ID NO: 3970 - DNA, 14 bp, synthetic construct
  source 1..14: mol_type = other DNA
ctagtcgtgtttaa

SEQ ID NO: 3971 - DNA, 14 bp, synthetic construct
  source 1..14: mol_type = other DNA
catactttatctgc

SEQ ID NO: 3972 - DNA, 14 bp, synthetic construct
  source 1..14: mol_type = other DNA
attgtatgatcaat

SEQ ID NO: 3973 - DNA, 14 bp, synthetic construct
  source 1..14: mol_type = other DNA
gttaattggacatt

SEQ ID NO: 3974 - DNA, 14 bp, synthetic construct
  source 1..14: mol_type = other DNA
cctttggatatcat

SEQ ID NO: 3975 - DNA, 14 bp, synthetic construct
  source 1..14: mol_type = other DNA
taattctggcgctt

SEQ ID NO: 3976 - DNA, 14 bp, synthetic construct
  source 1..14: mol_type = other DNA
tcgttatctccaat

SEQ ID NO: 3977 - DNA, 14 bp, synthetic construct
  source 1..14: mol_type = other DNA
gaatttttactgcc

SEQ ID NO: 3978 - DNA, 14 bp, synthetic construct
  source 1..14: mol_type = other DNA
ttggccctgatctt

SEQ ID NO: 3979 - DNA, 14 bp, synthetic construct
  source 1..14: mol_type = other DNA
ttgccggtcatttc

SEQ ID NO: 3980 - DNA, 14 bp, synthetic construct
  source 1..14: mol_type = other DNA
tgacggtttatcct

SEQ ID NO: 3981 - DNA, 14 bp, synthetic construct
  source 1..14: mol_type = other DNA
tggtgcactattgt

SEQ ID NO: 3982 - DNA, 14 bp, synthetic construct
  source 1..14: mol_type = other DNA
gtcctactgtatat

SEQ ID NO: 3983 - DNA, 14 bp, synthetic construct
  source 1..14: mol_type = other DNA
ccgatacttattat

SEQ ID NO: 3984 - DNA, 14 bp, synthetic construct
  source 1..14: mol_type = other DNA
gtttcctgcgctgt

SEQ ID NO: 3985 - DNA, 14 bp, synthetic construct
  source 1..14: mol_type = other DNA
tttaacctcctgta

SEQ ID NO: 3986 - DNA, 14 bp, synthetic construct
  source 1..14: mol_type = other DNA
ctttttcactcgga

SEQ ID NO: 3987 - DNA, 14 bp, synthetic construct
  source 1..14: mol_type = other DNA
ctttaatgatggat

SEQ ID NO: 3988 - DNA, 14 bp, synthetic construct
  source 1..14: mol_type = other DNA
tctagttaactgtc

SEQ ID NO: 3989 - DNA, 14 bp, synthetic construct
  source 1..14: mol_type = other DNA
atcttgtttcggga

SEQ ID NO: 3990 - DNA, 14 bp, synthetic construct
  source 1..14: mol_type = other DNA
gttagtaatttcac

SEQ ID NO: 3991 - DNA, 14 bp, synthetic construct
  source 1..14: mol_type = other DNA
gtttgataaaagtt

SEQ ID NO: 3992 - DNA, 14 bp, synthetic construct
  source 1..14: mol_type = other DNA
tccattcaggtatt

SEQ ID NO: 3993 - DNA, 14 bp, synthetic construct
  source 1..14: mol_type = other DNA
gggtcttcttaggt

SEQ ID NO: 3994 - DNA, 14 bp, synthetic construct
  source 1..14: mol_type = other DNA
tcctttgctacagt

SEQ ID NO: 3995 - DNA, 14 bp, synthetic construct
  source 1..14: mol_type = other DNA
attaggtttaactg

SEQ ID NO: 3996 - DNA, 14 bp, synthetic construct
  source 1..14: mol_type = other DNA
ctcgattattctgc

SEQ ID NO: 3997 - DNA, 14 bp, synthetic construct
  source 1..14: mol_type = other DNA
tctcctccgctctt

SEQ ID NO: 3998 - DNA, 14 bp, synthetic construct
  source 1..14: mol_type = other DNA
acttagattcgtta

SEQ ID NO: 3999 - DNA, 14 bp, synthetic construct
  source 1..14: mol_type = other DNA
tcaggattttagat

SEQ ID NO: 4000 - DNA, 14 bp, synthetic construct
  source 1..14: mol_type = other DNA
ctcttcctagtgat

SEQ ID NO: 4001 - DNA, 14 bp, synthetic construct
  source 1..14: mol_type = other DNA
gtattaagatgatt

SEQ ID NO: 4002 - DNA, 14 bp, synthetic construct
  source 1..14: mol_type = other DNA
gattgtcttctgcg

SEQ ID NO: 4003 - DNA, 14 bp, synthetic construct
  source 1..14: mol_type = other DNA
gttctaccgttctc

SEQ ID NO: 4004 - DNA, 14 bp, synthetic construct
  source 1..14: mol_type = other DNA
catatctgaatctt

SEQ ID NO: 4005 - DNA, 14 bp, synthetic construct
  source 1..14: mol_type = other DNA
tagtcaattaagtt

SEQ ID NO: 4006 - DNA, 14 bp, synthetic construct
  source 1..14: mol_type = other DNA
gattttgttgccaa

SEQ ID NO: 4007 - DNA, 14 bp, synthetic construct
  source 1..14: mol_type = other DNA
cccgttattatagt

SEQ ID NO: 4008 - DNA, 14 bp, synthetic construct
  source 1..14: mol_type = other DNA
gctttgtaactgtg

SEQ ID NO: 4009 - DNA, 14 bp, synthetic construct
  source 1..14: mol_type = other DNA
acattatttgaggt

SEQ ID NO: 4010 - DNA, 14 bp, synthetic construct
  source 1..14: mol_type = other DNA
gcttttggcgttcc

SEQ ID NO: 4011 - DNA, 14 bp, synthetic construct
  source 1..14: mol_type = other DNA
atgcgtcttctact

SEQ ID NO: 4012 - DNA, 14 bp, synthetic construct
  source 1..14: mol_type = other DNA
tttctgacattagc

SEQ ID NO: 4013 - DNA, 14 bp, synthetic construct
  source 1..14: mol_type = other DNA
ttgtggcctccttg

SEQ ID NO: 4014 - DNA, 14 bp, synthetic construct
  source 1..14: mol_type = other DNA
atcttcaacgttgt

SEQ ID NO: 4015 - DNA, 14 bp, synthetic construct
  source 1..14: mol_type = other DNA
ctgttctcaatctc

SEQ ID NO: 4016 - DNA, 14 bp, synthetic construct
  source 1..14: mol_type = other DNA
cactagtttacgtt

SEQ ID NO: 4017 - DNA, 14 bp, synthetic construct
  source 1..14: mol_type = other DNA
ttctgcatgctgat

SEQ ID NO: 4018 - DNA, 14 bp, synthetic construct
  source 1..14: mol_type = other DNA
agcactcttgttta

SEQ ID NO: 4019 - DNA, 14 bp, synthetic construct
  source 1..14: mol_type = other DNA
ctggtaatttatca

SEQ ID NO: 4020 - DNA, 14 bp, synthetic construct
  source 1..14: mol_type = other DNA
ttggggtccatgtt

SEQ ID NO: 4021 - DNA, 14 bp, synthetic construct
  source 1..14: mol_type = other DNA
catatggtctatta

SEQ ID NO: 4022 - DNA, 14 bp, synthetic construct
  source 1..14: mol_type = other DNA
gtaacgattttgta

SEQ ID NO: 4023 - DNA, 14 bp, synthetic construct
  source 1..14: mol_type = other DNA
ctgtcgttatctcc

SEQ ID NO: 4024 - DNA, 14 bp, synthetic construct
  source 1..14: mol_type = other DNA
gtcgttatcgcatt

SEQ ID NO: 4025 - DNA, 14 bp, synthetic construct
  source 1..14: mol_type = other DNA
ctccttttggcaat

SEQ ID NO: 4026 - DNA, 14 bp, synthetic construct
  source 1..14: mol_type = other DNA
cgttttaaattccc

SEQ ID NO: 4027 - DNA, 14 bp, synthetic construct
  source 1..14: mol_type = other DNA
acgttcattaaatt

SEQ ID NO: 4028 - DNA, 14 bp, synthetic construct
  source 1..14: mol_type = other DNA
acttgtttacgcct

SEQ ID NO: 4029 - DNA, 14 bp, synthetic construct
  source 1..14: mol_type = other DNA
ctctattcaattgc

SEQ ID NO: 4030 - DNA, 14 bp, synthetic construct
  source 1..14: mol_type = other DNA
agccttgttatggt

SEQ ID NO: 4031 - DNA, 14 bp, synthetic construct
  source 1..14: mol_type = other DNA
atgactctgtgtct

SEQ ID NO: 4032 - DNA, 14 bp, synthetic construct
  source 1..14: mol_type = other DNA
tatcttgagattca

SEQ ID NO: 4033 - DNA, 14 bp, synthetic construct
  source 1..14: mol_type = other DNA
atactggctgttta

SEQ ID NO: 4034 - DNA, 14 bp, synthetic construct
  source 1..14: mol_type = other DNA
ttttcgctggtcgg

SEQ ID NO: 4035 - DNA, 14 bp, synthetic construct
  source 1..14: mol_type = other DNA
atttcgtgatatgc

SEQ ID NO: 4036 - DNA, 14 bp, synthetic construct
  source 1..14: mol_type = other DNA
tccgtttctgatga

SEQ ID NO: 4037 - DNA, 14 bp, synthetic construct
  source 1..14: mol_type = other DNA
catattgctttccc

SEQ ID NO: 4038 - DNA, 14 bp, synthetic construct
  source 1..14: mol_type = other DNA
aactctcttaattg

SEQ ID NO: 4039 - DNA, 14 bp, synthetic construct
  source 1..14: mol_type = other DNA
tgacgttgacattt

SEQ ID NO: 4040 - DNA, 14 bp, synthetic construct
  source 1..14: mol_type = other DNA
tgccctgttgtctt

SEQ ID NO: 4041 - DNA, 14 bp, synthetic construct
  source 1..14: mol_type = other DNA
cgaagtttgatttt

SEQ ID NO: 4042 - DNA, 14 bp, synthetic construct
  source 1..14: mol_type = other DNA
ttctttagatgggt

SEQ ID NO: 4043 - DNA, 14 bp, synthetic construct
  source 1..14: mol_type = other DNA
tagacctatttctt

SEQ ID NO: 4044 - DNA, 14 bp, synthetic construct
  source 1..14: mol_type = other DNA
attatttacgtcgt

SEQ ID NO: 4045 - DNA, 14 bp, synthetic construct
  source 1..14: mol_type = other DNA
tagtatttcgttcc

SEQ ID NO: 4046 - DNA, 14 bp, synthetic construct
  source 1..14: mol_type = other DNA
gtcactttcttaat

SEQ ID NO: 4047 - DNA, 14 bp, synthetic construct
  source 1..14: mol_type = other DNA
tagcctgtatgttt

SEQ ID NO: 4048 - DNA, 14 bp, synthetic construct
  source 1..14: mol_type = other DNA
ctttacttagatct

SEQ ID NO: 4049 - DNA, 14 bp, synthetic construct
  source 1..14: mol_type = other DNA
tttagagtgtttag

SEQ ID NO: 4050 - DNA, 14 bp, synthetic construct
  source 1..14: mol_type = other DNA
cttgccttttatgc

SEQ ID NO: 4051 - DNA, 14 bp, synthetic construct
  source 1..14: mol_type = other DNA
tattgttatgtgaa

SEQ ID NO: 4052 - DNA, 14 bp, synthetic construct
  source 1..14: mol_type = other DNA
gtccttaattcctt

SEQ ID NO: 4053 - DNA, 14 bp, synthetic construct
  source 1..14: mol_type = other DNA
ttttggtcatctaa

SEQ ID NO: 4054 - DNA, 14 bp, synthetic construct
  source 1..14: mol_type = other DNA
tgtttgatcgcatt

SEQ ID NO: 4055 - DNA, 14 bp, synthetic construct
  source 1..14: mol_type = other DNA
tactttagcgattt

SEQ ID NO: 4056 - DNA, 14 bp, synthetic construct
  source 1..14: mol_type = other DNA
atagattttctcat

SEQ ID NO: 4057 - DNA, 14 bp, synthetic construct
  source 1..14: mol_type = other DNA
ttatcttgtatgcc

SEQ ID NO: 4058 - DNA, 14 bp, synthetic construct
  source 1..14: mol_type = other DNA
ttcgtgtagtgtgt

SEQ ID NO: 4059 - DNA, 14 bp, synthetic construct
  source 1..14: mol_type = other DNA
tcttcgcttcgtat

SEQ ID NO: 4060 - DNA, 14 bp, synthetic construct
  source 1..14: mol_type = other DNA
gctccttgttactt

SEQ ID NO: 4061 - DNA, 14 bp, synthetic construct
  source 1..14: mol_type = other DNA
actcttttcagatt

SEQ ID NO: 4062 - DNA, 14 bp, synthetic construct
  source 1..14: mol_type = other DNA
gtgatctatgattt

SEQ ID NO: 4063 - DNA, 14 bp, synthetic construct
  source 1..14: mol_type = other DNA
taactgctatcttt

SEQ ID NO: 4064 - DNA, 14 bp, synthetic construct
  source 1..14: mol_type = other DNA
actttttagatgct

SEQ ID NO: 4065 - DNA, 14 bp, synthetic construct
  source 1..14: mol_type = other DNA
tatttgtgttacca

SEQ ID NO: 4066 - DNA, 14 bp, synthetic construct
  source 1..14: mol_type = other DNA
tctccgtaatttgt

SEQ ID NO: 4067 - DNA, 14 bp, synthetic construct
  source 1..14: mol_type = other DNA
tgcccttaattttc

SEQ ID NO: 4068 - DNA, 14 bp, synthetic construct
  source 1..14: mol_type = other DNA
acgtatcgtttttg

SEQ ID NO: 4069 - DNA, 14 bp, synthetic construct
  source 1..14: mol_type = other DNA
gtcagtgtactttt

SEQ ID NO: 4070 - DNA, 14 bp, synthetic construct
  source 1..14: mol_type = other DNA
ttgccttgtgatta

SEQ ID NO: 4071 - DNA, 14 bp, synthetic construct
  source 1..14: mol_type = other DNA
ggggattttaattt

SEQ ID NO: 4072 - DNA, 14 bp, synthetic construct
  source 1..14: mol_type = other DNA
tttgttgtcgtgcc

SEQ ID NO: 4073 - DNA, 14 bp, synthetic construct
  source 1..14: mol_type = other DNA
atattttgccctta

SEQ ID NO: 4074 - DNA, 14 bp, synthetic construct
  source 1..14: mol_type = other DNA
tcttattggtcgta

SEQ ID NO: 4075 - DNA, 14 bp, synthetic construct
  source 1..14: mol_type = other DNA
gcttaaattttgtg

SEQ ID NO: 4076 - DNA, 14 bp, synthetic construct
  source 1..14: mol_type = other DNA
agttgttgattata

SEQ ID NO: 4077 - DNA, 14 bp, synthetic construct
  source 1..14: mol_type = other DNA
cattctgtattgtg

SEQ ID NO: 4078 - DNA, 14 bp, synthetic construct
  source 1..14: mol_type = other DNA
tttcattatggtaa

SEQ ID NO: 4079 - DNA, 14 bp, synthetic construct
  source 1..14: mol_type = other DNA
tgtacttactctgt

SEQ ID NO: 4080 - DNA, 14 bp, synthetic construct
  source 1..14: mol_type = other DNA
atcttaactgcttt

SEQ ID NO: 4081 - DNA, 14 bp, synthetic construct
  source 1..14: mol_type = other DNA
tgttataacttcta

SEQ ID NO: 4082 - DNA, 14 bp, synthetic construct
  source 1..14: mol_type = other DNA
gtttattcgtatgc

SEQ ID NO: 4083 - DNA, 14 bp, synthetic construct
  source 1..14: mol_type = other DNA
gtgcttttccttta

SEQ ID NO: 4084 - DNA, 14 bp, synthetic construct
  source 1..14: mol_type = other DNA
tcatttcacttgtt

SEQ ID NO: 4085 - DNA, 14 bp, synthetic construct
  source 1..14: mol_type = other DNA
gatttttctcagtt

SEQ ID NO: 4086 - DNA, 14 bp, synthetic construct
  source 1..14: mol_type = other DNA
gtattggttttgct

SEQ ID NO: 4087 - DNA, 14 bp, synthetic construct
  source 1..14: mol_type = other DNA
tatcctttgcttgt

SEQ ID NO: 4088 - DNA, 14 bp, synthetic construct
  source 1..14: mol_type = other DNA
cttttgcttgcttg

SEQ ID NO: 4089 - DNA, 14 bp, synthetic construct
  source 1..14: mol_type = other DNA
tttgttgcttgatg

SEQ ID NO: 4090 - DNA, 14 bp, synthetic construct
  source 1..14: mol_type = other DNA
tctttggattttcc

SEQ ID NO: 4091 - DNA, 14 bp, synthetic construct
  source 1..14: mol_type = other DNA
atttgtgtttgctg

SEQ ID NO: 4092 - DNA, 14 bp, synthetic construct
  source 1..14: mol_type = other DNA
tgtacggtttttta

SEQ ID NO: 4093 - DNA, 14 bp, synthetic construct
  source 1..14: mol_type = other DNA
ccgtaattattttt

SEQ ID NO: 4094 - DNA, 14 bp, synthetic construct
  source 1..14: mol_type = other DNA
tttttgcgtagatt

SEQ ID NO: 4095 - DNA, 14 bp, synthetic construct
  source 1..14: mol_type = other DNA
gtgttcgttgtatt

SEQ ID NO: 4096 - DNA, 14 bp, synthetic construct
  source 1..14: mol_type = other DNA
tctcattatctttg

SEQ ID NO: 4097 - DNA, 14 bp, synthetic construct
  source 1..14: mol_type = other DNA
tggtgcttcctttt

SEQ ID NO: 4098 - DNA, 14 bp, synthetic construct
  source 1..14: mol_type = other DNA
gtttttcaatgctt

SEQ ID NO: 4099 - DNA, 14 bp, synthetic construct
  source 1..14: mol_type = other DNA
ttgcttgattaatt

SEQ ID NO: 4100 - DNA, 14 bp, synthetic construct
  source 1..14: mol_type = other DNA
tattttgtcttgaa

SEQ ID NO: 4101 - DNA, 14 bp, synthetic construct
  source 1..14: mol_type = other DNA
ctttattgctttag

SEQ ID NO: 4102 - DNA, 14 bp, synthetic construct
  source 1..14: mol_type = other DNA
gttccattttcatt

SEQ ID NO: 4103 - DNA, 14 bp, synthetic construct
  source 1..14: mol_type = other DNA
gttagttgtttact

SEQ ID NO: 4104 - DNA, 14 bp, synthetic construct
  source 1..14: mol_type = other DNA
tttctctgtaatct

SEQ ID NO: 4105 - DNA, 14 bp, synthetic construct
  source 1..14: mol_type = other DNA
ccttttccttgtct

SEQ ID NO: 4106 - DNA, 14 bp, synthetic construct
  source 1..14: mol_type = other DNA
ttctttgagtgtta

SEQ ID NO: 4107 - DNA, 14 bp, synthetic construct
  source 1..14: mol_type = other DNA
ttactgtcttgctt

SEQ ID NO: 4108 - DNA, 14 bp, synthetic construct
  source 1..14: mol_type = other DNA
tccttatttttggg

SEQ ID NO: 4109 - DNA, 14 bp, synthetic construct
  source 1..14: mol_type = other DNA
tttgtgtaattcct

SEQ ID NO: 4110 - DNA, 14 bp, synthetic construct
  source 1..14: mol_type = other DNA
atgtatttttcgct

SEQ ID NO: 4111 - DNA, 14 bp, synthetic construct
  source 1..14: mol_type = other DNA
aatactttttggtt

SEQ ID NO: 4112 - DNA, 14 bp, synthetic construct
  source 1..14: mol_type = other DNA
cctttattcggttt

SEQ ID NO: 4113 - DNA, 14 bp, synthetic construct
  source 1..14: mol_type = other DNA
ttcgatcgtttgtt

SEQ ID NO: 4114 - DNA, 14 bp, synthetic construct
  source 1..14: mol_type = other DNA
gttttacttttcgg

SEQ ID NO: 4115 - DNA, 14 bp, synthetic construct
  source 1..14: mol_type = other DNA
tttactctgtattc

SEQ ID NO: 4116 - DNA, 14 bp, synthetic construct
  source 1..14: mol_type = other DNA
tttagtctgttagt

SEQ ID NO: 4117 - DNA, 14 bp, synthetic construct
  source 1..14: mol_type = other DNA
ttgttttcatcatg

SEQ ID NO: 4118 - DNA, 14 bp, synthetic construct
  source 1..14: mol_type = other DNA
agtttttccatttt

SEQ ID NO: 4119 - DNA, 14 bp, synthetic construct
  source 1..14: mol_type = other DNA
atcgtcttttcttt

SEQ ID NO: 4120 - DNA, 14 bp, synthetic construct
  source 1..14: mol_type = other DNA
attgtgttcttatt

SEQ ID NO: 4121 - DNA, 14 bp, synthetic construct
  source 1..14: mol_type = other DNA
ttccgtatttgttt

SEQ ID NO: 4122 - DNA, 14 bp, synthetic construct
  source 1..14: mol_type = other DNA
tagtgtttttgttg

SEQ ID NO: 4123 - DNA, 14 bp, synthetic construct
  source 1..14: mol_type = other DNA
ctttgcttgttttg

SEQ ID NO: 4124 - DNA, 14 bp, synthetic construct
  source 1..14: mol_type = other DNA
ttttctttcgttga

SEQ ID NO: 4125 - DNA, 14 bp, synthetic construct
  source 1..14: mol_type = other DNA
ttgcttctatttgt

SEQ ID NO: 4126 - DNA, 14 bp, synthetic construct
  source 1..14: mol_type = other DNA
ctggaagaacccgc

SEQ ID NO: 4127 - DNA, 14 bp, synthetic construct
  source 1..14: mol_type = other DNA
cacgcgacgatacc

SEQ ID NO: 4128 - DNA, 14 bp, synthetic construct
  source 1..14: mol_type = other DNA
ggcgatcagggcag

SEQ ID NO: 4129 - DNA, 14 bp, synthetic construct
  source 1..14: mol_type = other DNA
tacacgagaaccga

SEQ ID NO: 4130 - DNA, 14 bp, synthetic construct
  source 1..14: mol_type = other DNA
gacacctccccaaa

SEQ ID NO: 4131 - DNA, 14 bp, synthetic construct
  source 1..14: mol_type = other DNA
agcgcgtcgaacag

SEQ ID NO: 4132 - DNA, 14 bp, synthetic construct
  source 1..14: mol_type = other DNA
aatcccccgcccaa

SEQ ID NO: 4133 - DNA, 14 bp, synthetic construct
  source 1..14: mol_type = other DNA
cagcaacgaaacgt

SEQ ID NO: 4134 - DNA, 14 bp, synthetic construct
  source 1..14: mol_type = other DNA
acccgcaaaggtgg

SEQ ID NO: 4135 - DNA, 14 bp, synthetic construct
  source 1..14: mol_type = other DNA
gcataaacggacca

SEQ ID NO: 4136 - DNA, 14 bp, synthetic construct
  source 1..14: mol_type = other DNA
atccagagccaacc

SEQ ID NO: 4137 - DNA, 14 bp, synthetic construct
  source 1..14: mol_type = other DNA
caaccggtcacggg

SEQ ID NO: 4138 - DNA, 14 bp, synthetic construct
  source 1..14: mol_type = other DNA
ggaggccagcctag

SEQ ID NO: 4139 - DNA, 14 bp, synthetic construct
  source 1..14: mol_type = other DNA
cagaactagcacga

SEQ ID NO: 4140 - DNA, 14 bp, synthetic construct
  source 1..14: mol_type = other DNA
agacccgcaatcag

SEQ ID NO: 4141 - DNA, 14 bp, synthetic construct
  source 1..14: mol_type = other DNA
accccctcgaccgc

SEQ ID NO: 4142 - DNA, 14 bp, synthetic construct
  source 1..14: mol_type = other DNA
aaccgtccgcagcg

SEQ ID NO: 4143 - DNA, 14 bp, synthetic construct
  source 1..14: mol_type = other DNA
agagcacgtaaggg

SEQ ID NO: 4144 - DNA, 14 bp, synthetic construct
  source 1..14: mol_type = other DNA
agacgggcacatgc

SEQ ID NO: 4145 - DNA, 14 bp, synthetic construct
  source 1..14: mol_type = other DNA
gataaaggagcccc

SEQ ID NO: 4146 - DNA, 14 bp, synthetic construct
  source 1..14: mol_type = other DNA
cacagctggaacca

SEQ ID NO: 4147 - DNA, 14 bp, synthetic construct
  source 1..14: mol_type = other DNA
gaaagacaacgagt

SEQ ID NO: 4148 - DNA, 14 bp, synthetic construct
  source 1..14: mol_type = other DNA
cgaggaaaaggtta

SEQ ID NO: 4149 - DNA, 14 bp, synthetic construct
  source 1..14: mol_type = other DNA
aacccaagtgtaaa

SEQ ID NO: 4150 - DNA, 14 bp, synthetic construct
  source 1..14: mol_type = other DNA
gcaaactccgggat

SEQ ID NO: 4151 - DNA, 14 bp, synthetic construct
  source 1..14: mol_type = other DNA
gccacttgggccag

SEQ ID NO: 4152 - DNA, 14 bp, synthetic construct
  source 1..14: mol_type = other DNA
aggcccacagcgtt

SEQ ID NO: 4153 - DNA, 14 bp, synthetic construct
  source 1..14: mol_type = other DNA
tgctacggcacaca

SEQ ID NO: 4154 - DNA, 14 bp, synthetic construct
  source 1..14: mol_type = other DNA
ctctcaaagaaaga

SEQ ID NO: 4155 - DNA, 14 bp, synthetic construct
  source 1..14: mol_type = other DNA
gcacccctcacagt

SEQ ID NO: 4156 - DNA, 14 bp, synthetic construct
  source 1..14: mol_type = other DNA
atccaggcagagtg

SEQ ID NO: 4157 - DNA, 14 bp, synthetic construct
  source 1..14: mol_type = other DNA
caggataaagactg

SEQ ID NO: 4158 - DNA, 14 bp, synthetic construct
  source 1..14: mol_type = other DNA
ctccaactcggggg

SEQ ID NO: 4159 - DNA, 14 bp, synthetic construct
  source 1..14: mol_type = other DNA
tatgggagccaacg

SEQ ID NO: 4160 - DNA, 14 bp, synthetic construct
  source 1..14: mol_type = other DNA
tccacgcgctgcac

SEQ ID NO: 4161 - DNA, 14 bp, synthetic construct
  source 1..14: mol_type = other DNA
tctaagcgcgcgag

SEQ ID NO: 4162 - DNA, 14 bp, synthetic construct
  source 1..14: mol_type = other DNA
gggggaactaggtg

SEQ ID NO: 4163 - DNA, 14 bp, synthetic construct
  source 1..14: mol_type = other DNA
aggcgcagaataat

SEQ ID NO: 4164 - DNA, 14 bp, synthetic construct
  source 1..14: mol_type = other DNA
atcaccaagtccgg

SEQ ID NO: 4165 - DNA, 14 bp, synthetic construct
  source 1..14: mol_type = other DNA
cacagtacgaagat

SEQ ID NO: 4166 - DNA, 14 bp, synthetic construct
  source 1..14: mol_type = other DNA
gcgcaaccgttaac

SEQ ID NO: 4167 - DNA, 14 bp, synthetic construct
  source 1..14: mol_type = other DNA
ccccatacccacgt

SEQ ID NO: 4168 - DNA, 14 bp, synthetic construct
  source 1..14: mol_type = other DNA
ggttagaagccccg

SEQ ID NO: 4169 - DNA, 14 bp, synthetic construct
  source 1..14: mol_type = other DNA
cgcccatgccgtag

SEQ ID NO: 4170 - DNA, 14 bp, synthetic construct
  source 1..14: mol_type = other DNA
ctgcaccactggga

SEQ ID NO: 4171 - DNA, 14 bp, synthetic construct
  source 1..14: mol_type = other DNA
cagcgggtcgatca

SEQ ID NO: 4172 - DNA, 14 bp, synthetic construct
  source 1..14: mol_type = other DNA
agggcacaccttcg

SEQ ID NO: 4173 - DNA, 14 bp, synthetic construct
  source 1..14: mol_type = other DNA
gagtgggcagcggt

SEQ ID NO: 4174 - DNA, 14 bp, synthetic construct
  source 1..14: mol_type = other DNA
aacaactccgtggc

SEQ ID NO: 4175 - DNA, 14 bp, synthetic construct
  source 1..14: mol_type = other DNA
tgtaaagcccccgc

SEQ ID NO: 4176 - DNA, 14 bp, synthetic construct
  source 1..14: mol_type = other DNA
gcacacgtaaagtg

SEQ ID NO: 4177 - DNA, 14 bp, synthetic construct
  source 1..14: mol_type = other DNA
aacggcctcctcgc

SEQ ID NO: 4178 - DNA, 14 bp, synthetic construct
  source 1..14: mol_type = other DNA
ctccgctacgcgaa

SEQ ID NO: 4179 - DNA, 14 bp, synthetic construct
  source 1..14: mol_type = other DNA
actgaaccactgga

SEQ ID NO: 4180 - DNA, 14 bp, synthetic construct
  source 1..14: mol_type = other DNA
agacggtccggtag

SEQ ID NO: 4181 - DNA, 14 bp, synthetic construct
  source 1..14: mol_type = other DNA
agggtagtgagcgg

SEQ ID NO: 4182 - DNA, 14 bp, synthetic construct
  source 1..14: mol_type = other DNA
ggagcgctgcatcc

SEQ ID NO: 4183 - DNA, 14 bp, synthetic construct
  source 1..14: mol_type = other DNA
ttacccaggcaaaa

SEQ ID NO: 4184 - DNA, 14 bp, synthetic construct
  source 1..14: mol_type = other DNA
gtcagagataccgc

SEQ ID NO: 4185 - DNA, 14 bp, synthetic construct
  source 1..14: mol_type = other DNA
agcggaggtacggt

SEQ ID NO: 4186 - DNA, 14 bp, synthetic construct
  source 1..14: mol_type = other DNA
ctccgagctaggac

SEQ ID NO: 4187 - DNA, 14 bp, synthetic construct
  source 1..14: mol_type = other DNA
ccaaagatagatca

SEQ ID NO: 4188 - DNA, 14 bp, synthetic construct
  source 1..14: mol_type = other DNA
gggcgaaaggtact

SEQ ID NO: 4189 - DNA, 14 bp, synthetic construct
  source 1..14: mol_type = other DNA
gttgcagggaaccc

SEQ ID NO: 4190 - DNA, 14 bp, synthetic construct
  source 1..14: mol_type = other DNA
gtctggcagcagaa

SEQ ID NO: 4191 - DNA, 14 bp, synthetic construct
  source 1..14: mol_type = other DNA
tcggagaacgtgag

SEQ ID NO: 4192 - DNA, 14 bp, synthetic construct
  source 1..14: mol_type = other DNA
cggtggagcgctca

SEQ ID NO: 4193 - DNA, 14 bp, synthetic construct
  source 1..14: mol_type = other DNA
gagcgccttagcac

SEQ ID NO: 4194 - DNA, 14 bp, synthetic construct
  source 1..14: mol_type = other DNA
tggccagagtcgcc

SEQ ID NO: 4195 - DNA, 14 bp, synthetic construct
  source 1..14: mol_type = other DNA
gcaagtcggcgctc

SEQ ID NO: 4196 - DNA, 14 bp, synthetic construct
  source 1..14: mol_type = other DNA
cccaatcgtaggaa

SEQ ID NO: 4197 - DNA, 14 bp, synthetic construct
  source 1..14: mol_type = other DNA
cgtggggaacggct

SEQ ID NO: 4198 - DNA, 14 bp, synthetic construct
  source 1..14: mol_type = other DNA
accaccgactggat

SEQ ID NO: 4199 - DNA, 14 bp, synthetic construct
  source 1..14: mol_type = other DNA
caaccagcgattag

SEQ ID NO: 4200 - DNA, 14 bp, synthetic construct
  source 1..14: mol_type = other DNA
ggcaccctctgaac

SEQ ID NO: 4201 - DNA, 14 bp, synthetic construct
  source 1..14: mol_type = other DNA
taaaaagacgcgta

SEQ ID NO: 4202 - DNA, 14 bp, synthetic construct
  source 1..14: mol_type = other DNA
accagccagctcat

SEQ ID NO: 4203 - DNA, 14 bp, synthetic construct
  source 1..14: mol_type = other DNA
gacaacgggtgtgc

SEQ ID NO: 4204 - DNA, 14 bp, synthetic construct
  source 1..14: mol_type = other DNA
ctagcccaatccga

SEQ ID NO: 4205 - DNA, 14 bp, synthetic construct
  source 1..14: mol_type = other DNA
ctatccaaacgagc

SEQ ID NO: 4206 - DNA, 14 bp, synthetic construct
  source 1..14: mol_type = other DNA
gaagcgtacgctcc

SEQ ID NO: 4207 - DNA, 14 bp, synthetic construct
  source 1..14: mol_type = other DNA
acgttcgcaggaaa

SEQ ID NO: 4208 - DNA, 14 bp, synthetic construct
  source 1..14: mol_type = other DNA
gaatgacgataagg

SEQ ID NO: 4209 - DNA, 14 bp, synthetic construct
  source 1..14: mol_type = other DNA
gaaataacgatcag

SEQ ID NO: 4210 - DNA, 14 bp, synthetic construct
  source 1..14: mol_type = other DNA
caatgcaacatggc

SEQ ID NO: 4211 - DNA, 14 bp, synthetic construct
  source 1..14: mol_type = other DNA
ctacaacggctgcg

SEQ ID NO: 4212 - DNA, 14 bp, synthetic construct
  source 1..14: mol_type = other DNA
tcacaatatgacac

SEQ ID NO: 4213 - DNA, 14 bp, synthetic construct
  source 1..14: mol_type = other DNA
ctattgcgggagaa

SEQ ID NO: 4214 - DNA, 14 bp, synthetic construct
  source 1..14: mol_type = other DNA
gagatccgctgtac

SEQ ID NO: 4215 - DNA, 14 bp, synthetic construct
  source 1..14: mol_type = other DNA
aaatcgatggcgct

SEQ ID NO: 4216 - DNA, 14 bp, synthetic construct
  source 1..14: mol_type = other DNA
tcacgagatccgta

SEQ ID NO: 4217 - DNA, 14 bp, synthetic construct
  source 1..14: mol_type = other DNA
ctatgccgggccat

SEQ ID NO: 4218 - DNA, 14 bp, synthetic construct
  source 1..14: mol_type = other DNA
tagtccctacggac

SEQ ID NO: 4219 - DNA, 14 bp, synthetic construct
  source 1..14: mol_type = other DNA
aggatgagttggcg

SEQ ID NO: 4220 - DNA, 14 bp, synthetic construct
  source 1..14: mol_type = other DNA
gcggctgtgaacct

SEQ ID NO: 4221 - DNA, 14 bp, synthetic construct
  source 1..14: mol_type = other DNA
ttgagcgaaggtca

SEQ ID NO: 4222 - DNA, 14 bp, synthetic construct
  source 1..14: mol_type = other DNA
gtatcccggataga

SEQ ID NO: 4223 - DNA, 14 bp, synthetic construct
  source 1..14: mol_type = other DNA
aacgccatatcgct

SEQ ID NO: 4224 - DNA, 14 bp, synthetic construct
  source 1..14: mol_type = other DNA
tctataacggcaga

SEQ ID NO: 4225 - DNA, 14 bp, synthetic construct
  source 1..14: mol_type = other DNA
gctcactgactacg

SEQ ID NO: 4226 - DNA, 14 bp, synthetic construct
  source 1..14: mol_type = other DNA
cgtcgcacaattcg

SEQ ID NO: 4227 - DNA, 14 bp, synthetic construct
  source 1..14: mol_type = other DNA
agtagagtaatgcc

SEQ ID NO: 4228 - DNA, 14 bp, synthetic construct
  source 1..14: mol_type = other DNA
gtgctcataacaaa

SEQ ID NO: 4229 - DNA, 14 bp, synthetic construct
  source 1..14: mol_type = other DNA
gggttgcaagaact

SEQ ID NO: 4230 - DNA, 14 bp, synthetic construct
  source 1..14: mol_type = other DNA
cctgacattcccca

SEQ ID NO: 4231 - DNA, 14 bp, synthetic construct
  source 1..14: mol_type = other DNA
ggcaattccgatca

SEQ ID NO: 4232 - DNA, 14 bp, synthetic construct
  source 1..14: mol_type = other DNA
gcacagtatctcga

SEQ ID NO: 4233 - DNA, 14 bp, synthetic construct
  source 1..14: mol_type = other DNA
aggggctatgtcgc

SEQ ID NO: 4234 - DNA, 14 bp, synthetic construct
  source 1..14: mol_type = other DNA
gcgctggaagtagt

SEQ ID NO: 4235 - DNA, 14 bp, synthetic construct
  source 1..14: mol_type = other DNA
tcgtgtcgacgcca

SEQ ID NO: 4236 - DNA, 14 bp, synthetic construct
  source 1..14: mol_type = other DNA
ctaccattgccgga

SEQ ID NO: 4237 - DNA, 14 bp, synthetic construct
  source 1..14: mol_type = other DNA
cactgcaatcaaat

SEQ ID NO: 4238 - DNA, 14 bp, synthetic construct
  source 1..14: mol_type = other DNA
aagtcaccttagag

SEQ ID NO: 4239 - DNA, 14 bp, synthetic construct
  source 1..14: mol_type = other DNA
aaggcattataacg

SEQ ID NO: 4240 - DNA, 14 bp, synthetic construct
  source 1..14: mol_type = other DNA
acctagaccgcttc

SEQ ID NO: 4241 - DNA, 14 bp, synthetic construct
  source 1..14: mol_type = other DNA
agcggactagtcgt

SEQ ID NO: 4242 - DNA, 14 bp, synthetic construct
  source 1..14: mol_type = other DNA
tggactcacgtccc

SEQ ID NO: 4243 - DNA, 14 bp, synthetic construct
  source 1..14: mol_type = other DNA
atagtccgcctaga

SEQ ID NO: 4244 - DNA, 14 bp, synthetic construct
  source 1..14: mol_type = other DNA
cattcaccccgtca

SEQ ID NO: 4245 - DNA, 14 bp, synthetic construct
  source 1..14: mol_type = other DNA
ttagcaccggtgcc

SEQ ID NO: 4246 - DNA, 14 bp, synthetic construct
  source 1..14: mol_type = other DNA
ccatgacccttcaa

SEQ ID NO: 4247 - DNA, 14 bp, synthetic construct
  source 1..14: mol_type = other DNA
atcagttcaacgcc

SEQ ID NO: 4248 - DNA, 14 bp, synthetic construct
  source 1..14: mol_type = other DNA
ccacatatcgcgta

SEQ ID NO: 4249 - DNA, 14 bp, synthetic construct
  source 1..14: mol_type = other DNA
aaagactcaattag

SEQ ID NO: 4250 - DNA, 14 bp, synthetic construct
  source 1..14: mol_type = other DNA
gtccggattaaaaa

SEQ ID NO: 4251 - DNA, 14 bp, synthetic construct
  source 1..14: mol_type = other DNA
ttacgctcggaagg

SEQ ID NO: 4252 - DNA, 14 bp, synthetic construct
  source 1..14: mol_type = other DNA
atcgccgtcactac

SEQ ID NO: 4253 - DNA, 14 bp, synthetic construct
  source 1..14: mol_type = other DNA
cgtgcccttagcaa

SEQ ID NO: 4254 - DNA, 14 bp, synthetic construct
  source 1..14: mol_type = other DNA
ccaaattcggatga

SEQ ID NO: 4255 - DNA, 14 bp, synthetic construct
  source 1..14: mol_type = other DNA
cctacacctagagt

SEQ ID NO: 4256 - DNA, 14 bp, synthetic construct
  source 1..14: mol_type = other DNA
cacgatttggagaa

SEQ ID NO: 4257 - DNA, 14 bp, synthetic construct
  source 1..14: mol_type = other DNA
cctcagagtagtgg

SEQ ID NO: 4258 - DNA, 14 bp, synthetic construct
  source 1..14: mol_type = other DNA
tatcgcaacagatc

SEQ ID NO: 4259 - DNA, 14 bp, synthetic construct
  source 1..14: mol_type = other DNA
cagcgctgggttaa

SEQ ID NO: 4260 - DNA, 14 bp, synthetic construct
  source 1..14: mol_type = other DNA
cgatccgatgtcca

SEQ ID NO: 4261 - DNA, 14 bp, synthetic construct
  source 1..14: mol_type = other DNA
ccattcgatacaaa

SEQ ID NO: 4262 - DNA, 14 bp, synthetic construct
  source 1..14: mol_type = other DNA
atcacaaatatgga

SEQ ID NO: 4263 - DNA, 14 bp, synthetic construct
  source 1..14: mol_type = other DNA
cgaatagcttcccg

SEQ ID NO: 4264 - DNA, 14 bp, synthetic construct
  source 1..14: mol_type = other DNA
cggaatttgggaca

SEQ ID NO: 4265 - DNA, 14 bp, synthetic construct
  source 1..14: mol_type = other DNA
gaggctcggtctgg

SEQ ID NO: 4266 - DNA, 14 bp, synthetic construct
  source 1..14: mol_type = other DNA
ggtatcgaggctaa

SEQ ID NO: 4267 - DNA, 14 bp, synthetic construct
  source 1..14: mol_type = other DNA
catgtaaaacgtag

SEQ ID NO: 4268 - DNA, 14 bp, synthetic construct
  source 1..14: mol_type = other DNA
atgtacagcaaatg

SEQ ID NO: 4269 - DNA, 14 bp, synthetic construct
  source 1..14: mol_type = other DNA
ccaccgtgatatct

SEQ ID NO: 4270 - DNA, 14 bp, synthetic construct
  source 1..14: mol_type = other DNA
tcgagaagactttc

SEQ ID NO: 4271 - DNA, 14 bp, synthetic construct
  source 1..14: mol_type = other DNA
ccctggttaccagt

SEQ ID NO: 4272 - DNA, 14 bp, synthetic construct
  source 1..14: mol_type = other DNA
gcttatcccgagat

SEQ ID NO: 4273 - DNA, 14 bp, synthetic construct
  source 1..14: mol_type = other DNA
gggagtggcttctg

SEQ ID NO: 4274 - DNA, 14 bp, synthetic construct
  source 1..14: mol_type = other DNA
aaggacggtctatt

SEQ ID NO: 4275 - DNA, 14 bp, synthetic construct
  source 1..14: mol_type = other DNA
ttatcacgagcgct

SEQ ID NO: 4276 - DNA, 14 bp, synthetic construct
  source 1..14: mol_type = other DNA
agtaacgttgatca

SEQ ID NO: 4277 - DNA, 14 bp, synthetic construct
  source 1..14: mol_type = other DNA
ccttagtatgcaaa

SEQ ID NO: 4278 - DNA, 14 bp, synthetic construct
  source 1..14: mol_type = other DNA
ccagtatgtgggat

SEQ ID NO: 4279 - DNA, 14 bp, synthetic construct
  source 1..14: mol_type = other DNA
ttagtaacagactc

SEQ ID NO: 4280 - DNA, 14 bp, synthetic construct
  source 1..14: mol_type = other DNA
gcaggttcaccgtt

SEQ ID NO: 4281 - DNA, 14 bp, synthetic construct
  source 1..14: mol_type = other DNA
gtgctctactgcac

SEQ ID NO: 4282 - DNA, 14 bp, synthetic construct
  source 1..14: mol_type = other DNA
acatatgcgctcgt

SEQ ID NO: 4283 - DNA, 14 bp, synthetic construct
  source 1..14: mol_type = other DNA
attgtaatgcccca

SEQ ID NO: 4284 - DNA, 14 bp, synthetic construct
  source 1..14: mol_type = other DNA
acacgctgtaactt

SEQ ID NO: 4285 - DNA, 14 bp, synthetic construct
  source 1..14: mol_type = other DNA
gacaccattgctgt

SEQ ID NO: 4286 - DNA, 14 bp, synthetic construct
  source 1..14: mol_type = other DNA
gcagtctatgtaac

SEQ ID NO: 4287 - DNA, 14 bp, synthetic construct
  source 1..14: mol_type = other DNA
ttagagatgacggt

SEQ ID NO: 4288 - DNA, 14 bp, synthetic construct
  source 1..14: mol_type = other DNA
tcttagaccaaact

SEQ ID NO: 4289 - DNA, 14 bp, synthetic construct
  source 1..14: mol_type = other DNA
acgcggtaataatt

SEQ ID NO: 4290 - DNA, 14 bp, synthetic construct
  source 1..14: mol_type = other DNA
ttcgctactagggc

SEQ ID NO: 4291 - DNA, 14 bp, synthetic construct
  source 1..14: mol_type = other DNA
cgattgcggactct

SEQ ID NO: 4292 - DNA, 14 bp, synthetic construct
  source 1..14: mol_type = other DNA
gatatagcaactgt

SEQ ID NO: 4293 - DNA, 14 bp, synthetic construct
  source 1..14: mol_type = other DNA
cctaatgcccggtt

SEQ ID NO: 4294 - DNA, 14 bp, synthetic construct
  source 1..14: mol_type = other DNA
agaggtcggtttac

SEQ ID NO: 4295 - DNA, 14 bp, synthetic construct
  source 1..14: mol_type = other DNA
ttacaaatcgctgg

SEQ ID NO: 4296 - DNA, 14 bp, synthetic construct
  source 1..14: mol_type = other DNA
cttatgataccaac

SEQ ID NO: 4297 - DNA, 14 bp, synthetic construct
  source 1..14: mol_type = other DNA
gatgtcgtggtcca

SEQ ID NO: 4298 - DNA, 14 bp, synthetic construct
  source 1..14: mol_type = other DNA
atcttcctgccaca

SEQ ID NO: 4299 - DNA, 14 bp, synthetic construct
  source 1..14: mol_type = other DNA
gaccttgctatcag

SEQ ID NO: 4300 - DNA, 14 bp, synthetic construct
  source 1..14: mol_type = other DNA
tccacaatcttaaa

SEQ ID NO: 4301 - DNA, 14 bp, synthetic construct
  source 1..14: mol_type = other DNA
agtgagttcccatg

SEQ ID NO: 4302 - DNA, 14 bp, synthetic construct
  source 1..14: mol_type = other DNA
gttcttagcgaggc

SEQ ID NO: 4303 - DNA, 14 bp, synthetic construct
  source 1..14: mol_type = other DNA
taccagatgggtgt

SEQ ID NO: 4304 - DNA, 14 bp, synthetic construct
  source 1..14: mol_type = other DNA
gcattcgggtataa

SEQ ID NO: 4305 - DNA, 14 bp, synthetic construct
  source 1..14: mol_type = other DNA
cagtacccttcata

SEQ ID NO: 4306 - DNA, 14 bp, synthetic construct
  source 1..14: mol_type = other DNA
gcagccatccattt

SEQ ID NO: 4307 - DNA, 14 bp, synthetic construct
  source 1..14: mol_type = other DNA
ggccactgtttaaa

SEQ ID NO: 4308 - DNA, 14 bp, synthetic construct
  source 1..14: mol_type = other DNA
gcatcatgtaaaat

SEQ ID NO: 4309 - DNA, 14 bp, synthetic construct
  source 1..14: mol_type = other DNA
tacgtgtgtacagc

SEQ ID NO: 4310 - DNA, 14 bp, synthetic construct
  source 1..14: mol_type = other DNA
tatactgccgcatg

SEQ ID NO: 4311 - DNA, 14 bp, synthetic construct
  source 1..14: mol_type = other DNA
catcatcgcttacg

SEQ ID NO: 4312 - DNA, 14 bp, synthetic construct
  source 1..14: mol_type = other DNA
cccaatatacttac

SEQ ID NO: 4313 - DNA, 14 bp, synthetic construct
  source 1..14: mol_type = other DNA
tctcaattcgcgaa

SEQ ID NO: 4314 - DNA, 14 bp, synthetic construct
  source 1..14: mol_type = other DNA
gataattctgcgaa

SEQ ID NO: 4315 - DNA, 14 bp, synthetic construct
  source 1..14: mol_type = other DNA
cgcttgtaagagtc

SEQ ID NO: 4316 - DNA, 14 bp, synthetic construct
  source 1..14: mol_type = other DNA
atcgggttaagatg

SEQ ID NO: 4317 - DNA, 14 bp, synthetic construct
  source 1..14: mol_type = other DNA
gggctcacggattt

SEQ ID NO: 4318 - DNA, 14 bp, synthetic construct
  source 1..14: mol_type = other DNA
tatgtcgcgaatag

SEQ ID NO: 4319 - DNA, 14 bp, synthetic construct
  source 1..14: mol_type = other DNA
actgactcctgatg

SEQ ID NO: 4320 - DNA, 14 bp, synthetic construct
  source 1..14: mol_type = other DNA
ctgtttacaggcga

SEQ ID NO: 4321 - DNA, 14 bp, synthetic construct
  source 1..14: mol_type = other DNA
gccaatcttcagtc

SEQ ID NO: 4322 - DNA, 14 bp, synthetic construct
  source 1..14: mol_type = other DNA
tcacgcgtaattcc

SEQ ID NO: 4323 - DNA, 14 bp, synthetic construct
  source 1..14: mol_type = other DNA
actggttacccaat

SEQ ID NO: 4324 - DNA, 14 bp, synthetic construct
  source 1..14: mol_type = other DNA
tgcgtagttaagga

SEQ ID NO: 4325 - DNA, 14 bp, synthetic construct
  source 1..14: mol_type = other DNA
cgcctcgatcttga

SEQ ID NO: 4326 - DNA, 14 bp, synthetic construct
  source 1..14: mol_type = other DNA
tggtcgtcccggtg

SEQ ID NO: 4327 - DNA, 14 bp, synthetic construct
  source 1..14: mol_type = other DNA
gtggttgtcccggc

SEQ ID NO: 4328 - DNA, 14 bp, synthetic construct
  source 1..14: mol_type = other DNA
tacggacccgtatt

SEQ ID NO: 4329 - DNA, 14 bp, synthetic construct
  source 1..14: mol_type = other DNA
tgccatctggatgg

SEQ ID NO: 4330 - DNA, 14 bp, synthetic construct
  source 1..14: mol_type = other DNA
cggcttctccctgc

SEQ ID NO: 4331 - DNA, 14 bp, synthetic construct
  source 1..14: mol_type = other DNA
cggtatgcttaaca

SEQ ID NO: 4332 - DNA, 14 bp, synthetic construct
  source 1..14: mol_type = other DNA
ggggaggttttcag

SEQ ID NO: 4333 - DNA, 14 bp, synthetic construct
  source 1..14: mol_type = other DNA
acggtggtactgct

SEQ ID NO: 4334 - DNA, 14 bp, synthetic construct
  source 1..14: mol_type = other DNA
aatcacattgggct

SEQ ID NO: 4335 - DNA, 14 bp, synthetic construct
  source 1..14: mol_type = other DNA
tcgtactccgtcac

SEQ ID NO: 4336 - DNA, 14 bp, synthetic construct
  source 1..14: mol_type = other DNA
ttcccgctcgtaaa

SEQ ID NO: 4337 - DNA, 14 bp, synthetic construct
  source 1..14: mol_type = other DNA
tcgcaaattaatgc

SEQ ID NO: 4338 - DNA, 14 bp, synthetic construct
  source 1..14: mol_type = other DNA
caccgttccttcgg

SEQ ID NO: 4339 - DNA, 14 bp, synthetic construct
  source 1..14: mol_type = other DNA
ggtcctaggtgact

SEQ ID NO: 4340 - DNA, 14 bp, synthetic construct
  source 1..14: mol_type = other DNA
caacattcttaaag

SEQ ID NO: 4341 - DNA, 14 bp, synthetic construct
  source 1..14: mol_type = other DNA
gcacttaattatcc

SEQ ID NO: 4342 - DNA, 14 bp, synthetic construct
  source 1..14: mol_type = other DNA
catacgcatgtctt

SEQ ID NO: 4343 - DNA, 14 bp, synthetic construct
  source 1..14: mol_type = other DNA
cactgttttgcaga

SEQ ID NO: 4344 - DNA, 14 bp, synthetic construct
  source 1..14: mol_type = other DNA
ttacccggattcgt

SEQ ID NO: 4345 - DNA, 14 bp, synthetic construct
  source 1..14: mol_type = other DNA
ctggtgctaatcat

SEQ ID NO: 4346 - DNA, 14 bp, synthetic construct
  source 1..14: mol_type = other DNA
tgcctatctcagtc

SEQ ID NO: 4347 - DNA, 14 bp, synthetic construct
  source 1..14: mol_type = other DNA
tgactaatcgtgta

SEQ ID NO: 4348 - DNA, 14 bp, synthetic construct
  source 1..14: mol_type = other DNA
ccgatatcatgttc

SEQ ID NO: 4349 - DNA, 14 bp, synthetic construct
  source 1..14: mol_type = other DNA
gtaggagttctctg

SEQ ID NO: 4350 - DNA, 14 bp, synthetic construct
  source 1..14: mol_type = other DNA
gatagccttcatta

SEQ ID NO: 4351 - DNA, 14 bp, synthetic construct
  source 1..14: mol_type = other DNA
tgcttagcaaatat

SEQ ID NO: 4352 - DNA, 14 bp, synthetic construct
  source 1..14: mol_type = other DNA
acctctaatgttcg

SEQ ID NO: 4353 - DNA, 14 bp, synthetic construct
  source 1..14: mol_type = other DNA
tcataccggacttt

SEQ ID NO: 4354 - DNA, 14 bp, synthetic construct
  source 1..14: mol_type = other DNA
gtgtatatctaaac

SEQ ID NO: 4355 - DNA, 14 bp, synthetic construct
  source 1..14: mol_type = other DNA
tgaaccagctattt

SEQ ID NO: 4356 - DNA, 14 bp, synthetic construct
  source 1..14: mol_type = other DNA
cgttttggccagat

SEQ ID NO: 4357 - DNA, 14 bp, synthetic construct
  source 1..14: mol_type = other DNA
ttctaatatgagaa

SEQ ID NO: 4358 - DNA, 14 bp, synthetic construct
  source 1..14: mol_type = other DNA
gtctactcggttag

SEQ ID NO: 4359 - DNA, 14 bp, synthetic construct
  source 1..14: mol_type = other DNA
aatattacagtcct

SEQ ID NO: 4360 - DNA, 14 bp, synthetic construct
  source 1..14: mol_type = other DNA
taacagaagttgtt

SEQ ID NO: 4361 - DNA, 14 bp, synthetic construct
  source 1..14: mol_type = other DNA
tcatcgatacttgg

SEQ ID NO: 4362 - DNA, 14 bp, synthetic construct
  source 1..14: mol_type = other DNA
ttcccgattgcgat

SEQ ID NO: 4363 - DNA, 14 bp, synthetic construct
  source 1..14: mol_type = other DNA
ctctcgggctttgc

SEQ ID NO: 4364 - DNA, 14 bp, synthetic construct
  source 1..14: mol_type = other DNA
cttcggctgggatt

SEQ ID NO: 4365 - DNA, 14 bp, synthetic construct
  source 1..14: mol_type = other DNA
ccgaggttgtgatt

SEQ ID NO: 4366 - DNA, 14 bp, synthetic construct
  source 1..14: mol_type = other DNA
ctttgcagttgggg

SEQ ID NO: 4367 - DNA, 14 bp, synthetic construct
  source 1..14: mol_type = other DNA
tgttatccgggatc

SEQ ID NO: 4368 - DNA, 14 bp, synthetic construct
  source 1..14: mol_type = other DNA
atgtagtaagttca

SEQ ID NO: 4369 - DNA, 14 bp, synthetic construct
  source 1..14: mol_type = other DNA
aagacgtttgctct

SEQ ID NO: 4370 - DNA, 14 bp, synthetic construct
  source 1..14: mol_type = other DNA
gtggatcttataga

SEQ ID NO: 4371 - DNA, 14 bp, synthetic construct
  source 1..14: mol_type = other DNA
atctggggacattt

SEQ ID NO: 4372 - DNA, 14 bp, synthetic construct
  source 1..14: mol_type = other DNA
cgttcctctgcctc

SEQ ID NO: 4373 - DNA, 14 bp, synthetic construct
  source 1..14: mol_type = other DNA
aatacctctctcta

SEQ ID NO: 4374 - DNA, 14 bp, synthetic construct
  source 1..14: mol_type = other DNA
cgtcgcttcgttag

SEQ ID NO: 4375 - DNA, 14 bp, synthetic construct
  source 1..14: mol_type = other DNA
tgaccttatccgtg

SEQ ID NO: 4376 - DNA, 14 bp, synthetic construct
  source 1..14: mol_type = other DNA
tgcccattgatggt

SEQ ID NO: 4377 - DNA, 14 bp, synthetic construct
  source 1..14: mol_type = other DNA
ggtgatgccttaat

SEQ ID NO: 4378 - DNA, 14 bp, synthetic construct
  source 1..14: mol_type = other DNA
tgtggaatccgctt

SEQ ID NO: 4379 - DNA, 14 bp, synthetic construct
  source 1..14: mol_type = other DNA
ccattaatcctaat

SEQ ID NO: 4380 - DNA, 14 bp, synthetic construct
  source 1..14: mol_type = other DNA
tcaacgaaattatt

SEQ ID NO: 4381 - DNA, 14 bp, synthetic construct
  source 1..14: mol_type = other DNA
ccgctctttgggta

SEQ ID NO: 4382 - DNA, 14 bp, synthetic construct
  source 1..14: mol_type = other DNA
cttgccatgagatt

SEQ ID NO: 4383 - DNA, 14 bp, synthetic construct
  source 1..14: mol_type = other DNA
gtattgcagcttcc

SEQ ID NO: 4384 - DNA, 14 bp, synthetic construct
  source 1..14: mol_type = other DNA
ttctactgtagact

SEQ ID NO: 4385 - DNA, 14 bp, synthetic construct
  source 1..14: mol_type = other DNA
gtcggcctttgttc

SEQ ID NO: 4386 - DNA, 14 bp, synthetic construct
  source 1..14: mol_type = other DNA
catgacttctgtct

SEQ ID NO: 4387 - DNA, 14 bp, synthetic construct
  source 1..14: mol_type = other DNA
atgctgtctctgct

SEQ ID NO: 4388 - DNA, 14 bp, synthetic construct
  source 1..14: mol_type = other DNA
tggcgagtttttgc

SEQ ID NO: 4389 - DNA, 14 bp, synthetic construct
  source 1..14: mol_type = other DNA
attcgttatctgcc

SEQ ID NO: 4390 - DNA, 14 bp, synthetic construct
  source 1..14: mol_type = other DNA
tttttgaactgggc

SEQ ID NO: 4391 - DNA, 14 bp, synthetic construct
  source 1..14: mol_type = other DNA
cttcggagcttttg

SEQ ID NO: 4392 - DNA, 14 bp, synthetic construct
  source 1..14: mol_type = other DNA
cgtgatattattga

SEQ ID NO: 4393 - DNA, 14 bp, synthetic construct
  source 1..14: mol_type = other DNA
ctatcggtagttat

SEQ ID NO: 4394 - DNA, 14 bp, synthetic construct
  source 1..14: mol_type = other DNA
ctattagtttgagg

SEQ ID NO: 4395 - DNA, 14 bp, synthetic construct
  source 1..14: mol_type = other DNA
ttaactctccgtgt

SEQ ID NO: 4396 - DNA, 14 bp, synthetic construct
  source 1..14: mol_type = other DNA
tgcttctgagttaa

SEQ ID NO: 4397 - DNA, 14 bp, synthetic construct
  source 1..14: mol_type = other DNA
tctcacgttagttc

SEQ ID NO: 4398 - DNA, 14 bp, synthetic construct
  source 1..14: mol_type = other DNA
cctgtattgtacta

SEQ ID NO: 4399 - DNA, 14 bp, synthetic construct
  source 1..14: mol_type = other DNA
gtcattatatctag

SEQ ID NO: 4400 - DNA, 14 bp, synthetic construct
  source 1..14: mol_type = other DNA
tttattgatgaggg

SEQ ID NO: 4401 - DNA, 14 bp, synthetic construct
  source 1..14: mol_type = other DNA
ttgtatttcaacga

SEQ ID NO: 4402 - DNA, 14 bp, synthetic construct
  source 1..14: mol_type = other DNA
aaactatttctgta

SEQ ID NO: 4403 - DNA, 14 bp, synthetic construct
  source 1..14: mol_type = other DNA
atttctcaagtctc

SEQ ID NO: 4404 - DNA, 14 bp, synthetic construct
  source 1..14: mol_type = other DNA
cctgatgtatactt

SEQ ID NO: 4405 - DNA, 14 bp, synthetic construct
  source 1..14: mol_type = other DNA
attaactatgtgat

SEQ ID NO: 4406 - DNA, 14 bp, synthetic construct
  source 1..14: mol_type = other DNA
atgtggtgtaattc

SEQ ID NO: 4407 - DNA, 14 bp, synthetic construct
  source 1..14: mol_type = other DNA
tattcacacttatc

SEQ ID NO: 4408 - DNA, 14 bp, synthetic construct
  source 1..14: mol_type = other DNA
ttctattgcgctcg

SEQ ID NO: 4409 - DNA, 14 bp, synthetic construct
  source 1..14: mol_type = other DNA
ttcatataccatta

SEQ ID NO: 4410 - DNA, 14 bp, synthetic construct
  source 1..14: mol_type = other DNA
ctgtccttctggta

SEQ ID NO: 4411 - DNA, 14 bp, synthetic construct
  source 1..14: mol_type = other DNA
tttaacagtcttgc

SEQ ID NO: 4412 - DNA, 14 bp, synthetic construct
  source 1..14: mol_type = other DNA
cgtatttaaggttg

SEQ ID NO: 4413 - DNA, 14 bp, synthetic construct
  source 1..14: mol_type = other DNA
ctagggatttgtat

SEQ ID NO: 4414 - DNA, 14 bp, synthetic construct
  source 1..14: mol_type = other DNA
cgtctattttgaca

SEQ ID NO: 4415 - DNA, 14 bp, synthetic construct
  source 1..14: mol_type = other DNA
cgtaccttcttcgt

SEQ ID NO: 4416 - DNA, 14 bp, synthetic construct
  source 1..14: mol_type = other DNA
cttacatgaaattt

SEQ ID NO: 4417 - DNA, 14 bp, synthetic construct
  source 1..14: mol_type = other DNA
taattaggttgtca

SEQ ID NO: 4418 - DNA, 14 bp, synthetic construct
  source 1..14: mol_type = other DNA
ttatatttaggccc

SEQ ID NO: 4419 - DNA, 14 bp, synthetic construct
  source 1..14: mol_type = other DNA
ctttgtgtcaacat

SEQ ID NO: 4420 - DNA, 14 bp, synthetic construct
  source 1..14: mol_type = other DNA
tctggttgtgcact

SEQ ID NO: 4421 - DNA, 14 bp, synthetic construct
  source 1..14: mol_type = other DNA
ctaacatgtctatt

SEQ ID NO: 4422 - DNA, 14 bp, synthetic construct
  source 1..14: mol_type = other DNA
ctagtattctgtcc

SEQ ID NO: 4423 - DNA, 14 bp, synthetic construct
  source 1..14: mol_type = other DNA
taagactatgcttt

SEQ ID NO: 4424 - DNA, 14 bp, synthetic construct
  source 1..14: mol_type = other DNA
ttctgtatgaacct

SEQ ID NO: 4425 - DNA, 14 bp, synthetic construct
  source 1..14: mol_type = other DNA
atgttgcatactta

SEQ ID NO: 4426 - DNA, 14 bp, synthetic construct
  source 1..14: mol_type = other DNA
cagtttattcatac

SEQ ID NO: 4427 - DNA, 14 bp, synthetic construct
  source 1..14: mol_type = other DNA
cgacccaagagaaa

SEQ ID NO: 4428 - DNA, 14 bp, synthetic construct
  source 1..14: mol_type = other DNA
aaacccacgaaacg

SEQ ID NO: 4429 - DNA, 14 bp, synthetic construct
  source 1..14: mol_type = other DNA
gaacgcgagccgga

SEQ ID NO: 4430 - DNA, 14 bp, synthetic construct
  source 1..14: mol_type = other DNA
cacgcaaaagagga

SEQ ID NO: 4431 - DNA, 14 bp, synthetic construct
  source 1..14: mol_type = other DNA
gcggcacacgagga

SEQ ID NO: 4432 - DNA, 14 bp, synthetic construct
  source 1..14: mol_type = other DNA
aggacgcagccaca

SEQ ID NO: 4433 - DNA, 14 bp, synthetic construct
  source 1..14: mol_type = other DNA
ggaacgggcagaag

SEQ ID NO: 4434 - DNA, 14 bp, synthetic construct
  source 1..14: mol_type = other DNA
ccacggaggaaggc

SEQ ID NO: 4435 - DNA, 14 bp, synthetic construct
  source 1..14: mol_type = other DNA
ccgacacaagagcg

SEQ ID NO: 4436 - DNA, 14 bp, synthetic construct
  source 1..14: mol_type = other DNA
ggagggggagaccc

SEQ ID NO: 4437 - DNA, 14 bp, synthetic construct
  source 1..14: mol_type = other DNA
aagcagccggggcc

SEQ ID NO: 4438 - DNA, 14 bp, synthetic construct
  source 1..14: mol_type = other DNA
cgccagccaggaac

SEQ ID NO: 4439 - DNA, 14 bp, synthetic construct
  source 1..14: mol_type = other DNA
aggacggcaggcag

SEQ ID NO: 4440 - DNA, 14 bp, synthetic construct
  source 1..14: mol_type = other DNA
cacgaccaaccagg

SEQ ID NO: 4441 - DNA, 14 bp, synthetic construct
  source 1..14: mol_type = other DNA
cagccagcaccccc

SEQ ID NO: 4442 - DNA, 14 bp, synthetic construct
  source 1..14: mol_type = other DNA
acccacgagagcaa

SEQ ID NO: 4443 - DNA, 14 bp, synthetic construct
  source 1..14: mol_type = other DNA
gggcaaggagggac

SEQ ID NO: 4444 - DNA, 14 bp, synthetic construct
  source 1..14: mol_type = other DNA
accggaggggaggc

SEQ ID NO: 4445 - DNA, 14 bp, synthetic construct
  source 1..14: mol_type = other DNA
gcgagaacgccgac

SEQ ID NO: 4446 - DNA, 14 bp, synthetic construct
  source 1..14: mol_type = other DNA
cgaggagagcagca

SEQ ID NO: 4447 - DNA, 14 bp, synthetic construct
  source 1..14: mol_type = other DNA
aaaccgagccagga

SEQ ID NO: 4448 - DNA, 14 bp, synthetic construct
  source 1..14: mol_type = other DNA
caccacgcgacacg

SEQ ID NO: 4449 - DNA, 14 bp, synthetic construct
  source 1..14: mol_type = other DNA
caaaaacgcgagga

SEQ ID NO: 4450 - DNA, 14 bp, synthetic construct
  source 1..14: mol_type = other DNA
aagaaaagacgccg

SEQ ID NO: 4451 - DNA, 14 bp, synthetic construct
  source 1..14: mol_type = other DNA
gcacaaaacagcag

SEQ ID NO: 4452 - DNA, 14 bp, synthetic construct
  source 1..14: mol_type = other DNA
ccccaagggaggag

SEQ ID NO: 4453 - DNA, 14 bp, synthetic construct
  source 1..14: mol_type = other DNA
aacaacgagcagcc

SEQ ID NO: 4454 - DNA, 14 bp, synthetic construct
  source 1..14: mol_type = other DNA
ccagagaaaaaccc

SEQ ID NO: 4455 - DNA, 14 bp, synthetic construct
  source 1..14: mol_type = other DNA
acggaagaaaaaag

SEQ ID NO: 4456 - DNA, 14 bp, synthetic construct
  source 1..14: mol_type = other DNA
ggaaagcgcacaga

SEQ ID NO: 4457 - DNA, 14 bp, synthetic construct
  source 1..14: mol_type = other DNA
accaaaaacagacg

SEQ ID NO: 4458 - DNA, 14 bp, synthetic construct
  source 1..14: mol_type = other DNA
aaaccaacagaaac

SEQ ID NO: 4459 - DNA, 14 bp, synthetic construct
  source 1..14: mol_type = other DNA
gacggacggcaggg

SEQ ID NO: 4460 - DNA, 14 bp, synthetic construct
  source 1..14: mol_type = other DNA
gggaaagaagcgcg

SEQ ID NO: 4461 - DNA, 14 bp, synthetic construct
  source 1..14: mol_type = other DNA
ccacggaggccaaa

SEQ ID NO: 4462 - DNA, 14 bp, synthetic construct
  source 1..14: mol_type = other DNA
cggaacccacccaa

SEQ ID NO: 4463 - DNA, 14 bp, synthetic construct
  source 1..14: mol_type = other DNA
aaaacggcaaaaag

SEQ ID NO: 4464 - DNA, 14 bp, synthetic construct
  source 1..14: mol_type = other DNA
gcctgaggcgacac

SEQ ID NO: 4465 - DNA, 14 bp, synthetic construct
  source 1..14: mol_type = other DNA
caggggtcccagcg

SEQ ID NO: 4466 - DNA, 14 bp, synthetic construct
  source 1..14: mol_type = other DNA
gcgactaaaacacc

SEQ ID NO: 4467 - DNA, 14 bp, synthetic construct
  source 1..14: mol_type = other DNA
gagaggggtaggga

SEQ ID NO: 4468 - DNA, 14 bp, synthetic construct
  source 1..14: mol_type = other DNA
gagtcgcgaagagg

SEQ ID NO: 4469 - DNA, 14 bp, synthetic construct
  source 1..14: mol_type = other DNA
aaggaatcaccgcc

SEQ ID NO: 4470 - DNA, 14 bp, synthetic construct
  source 1..14: mol_type = other DNA
gaatgcaacgaacg

SEQ ID NO: 4471 - DNA, 14 bp, synthetic construct
  source 1..14: mol_type = other DNA
cgcccaaaacagat

SEQ ID NO: 4472 - DNA, 14 bp, synthetic construct
  source 1..14: mol_type = other DNA
gcagagcccgacgt

SEQ ID NO: 4473 - DNA, 14 bp, synthetic construct
  source 1..14: mol_type = other DNA
gaccgaggacctgc

SEQ ID NO: 4474 - DNA, 14 bp, synthetic construct
  source 1..14: mol_type = other DNA
agagtcccaagaac

SEQ ID NO: 4475 - DNA, 14 bp, synthetic construct
  source 1..14: mol_type = other DNA
gaccgcacatcccc

SEQ ID NO: 4476 - DNA, 14 bp, synthetic construct
  source 1..14: mol_type = other DNA
acagggaggtgcag

SEQ ID NO: 4477 - DNA, 14 bp, synthetic construct
  source 1..14: mol_type = other DNA
catcggcaagcagc

SEQ ID NO: 4478 - DNA, 14 bp, synthetic construct
  source 1..14: mol_type = other DNA
cggacatacgcacg

SEQ ID NO: 4479 - DNA, 14 bp, synthetic construct
  source 1..14: mol_type = other DNA
ctgggaaagccaca

SEQ ID NO: 4480 - DNA, 14 bp, synthetic construct
  source 1..14: mol_type = other DNA
ccaccccactaaag

SEQ ID NO: 4481 - DNA, 14 bp, synthetic construct
  source 1..14: mol_type = other DNA
ccgccatcaggcac

SEQ ID NO: 4482 - DNA, 14 bp, synthetic construct
  source 1..14: mol_type = other DNA
gaagagagataaaa

SEQ ID NO: 4483 - DNA, 14 bp, synthetic construct
  source 1..14: mol_type = other DNA
gcagcggtcgaagg

SEQ ID NO: 4484 - DNA, 14 bp, synthetic construct
  source 1..14: mol_type = other DNA
atcgaccagagggg

SEQ ID NO: 4485 - DNA, 14 bp, synthetic construct
  source 1..14: mol_type = other DNA
aggcctcaaagaac

SEQ ID NO: 4486 - DNA, 14 bp, synthetic construct
  source 1..14: mol_type = other DNA
ccaagcgtcgaagc

SEQ ID NO: 4487 - DNA, 14 bp, synthetic construct
  source 1..14: mol_type = other DNA
accgacaactcgga

SEQ ID NO: 4488 - DNA, 14 bp, synthetic construct
  source 1..14: mol_type = other DNA
ggaataaggagacc

SEQ ID NO: 4489 - DNA, 14 bp, synthetic construct
  source 1..14: mol_type = other DNA
ctccgaccacccgc

SEQ ID NO: 4490 - DNA, 14 bp, synthetic construct
  source 1..14: mol_type = other DNA
cgacgtccacaccc

SEQ ID NO: 4491 - DNA, 14 bp, synthetic construct
  source 1..14: mol_type = other DNA
caaagcaccaataa

SEQ ID NO: 4492 - DNA, 14 bp, synthetic construct
  source 1..14: mol_type = other DNA
ggtgcaggggcaag

SEQ ID NO: 4493 - DNA, 14 bp, synthetic construct
  source 1..14: mol_type = other DNA
gcaagcagggggtg

SEQ ID NO: 4494 - DNA, 14 bp, synthetic construct
  source 1..14: mol_type = other DNA
ccgggacagacgct

SEQ ID NO: 4495 - DNA, 14 bp, synthetic construct
  source 1..14: mol_type = other DNA
caccgcgtcagcga

SEQ ID NO: 4496 - DNA, 14 bp, synthetic construct
  source 1..14: mol_type = other DNA
caaaacctgaaccg

SEQ ID NO: 4497 - DNA, 14 bp, synthetic construct
  source 1..14: mol_type = other DNA
gcacccatagggac

SEQ ID NO: 4498 - DNA, 14 bp, synthetic construct
  source 1..14: mol_type = other DNA
ctacacacaagaag

SEQ ID NO: 4499 - DNA, 14 bp, synthetic construct
  source 1..14: mol_type = other DNA
gtgcagagggacag

SEQ ID NO: 4500 - DNA, 14 bp, synthetic construct
  source 1..14: mol_type = other DNA
caaaccccgatagg

SEQ ID NO: 4501 - DNA, 14 bp, synthetic construct
  source 1..14: mol_type = other DNA
gggtacacgagacc

SEQ ID NO: 4502 - DNA, 14 bp, synthetic construct
  source 1..14: mol_type = other DNA
cgaggtcacggccc

SEQ ID NO: 4503 - DNA, 14 bp, synthetic construct
  source 1..14: mol_type = other DNA
gtgagaacacgagg

SEQ ID NO: 4504 - DNA, 14 bp, synthetic construct
  source 1..14: mol_type = other DNA
caagagtcagacac

SEQ ID NO: 4505 - DNA, 14 bp, synthetic construct
  source 1..14: mol_type = other DNA
cgagagtgacgcag

SEQ ID NO: 4506 - DNA, 14 bp, synthetic construct
  source 1..14: mol_type = other DNA
cagagtcaacacaa

SEQ ID NO: 4507 - DNA, 14 bp, synthetic construct
  source 1..14: mol_type = other DNA
ctaaaacaaaacgc

SEQ ID NO: 4508 - DNA, 14 bp, synthetic construct
  source 1..14: mol_type = other DNA
aaacagggccatag

SEQ ID NO: 4509 - DNA, 14 bp, synthetic construct
  source 1..14: mol_type = other DNA
aaaccagaccctgc

SEQ ID NO: 4510 - DNA, 14 bp, synthetic construct
  source 1..14: mol_type = other DNA
cgaggggacagata

SEQ ID NO: 4511 - DNA, 14 bp, synthetic construct
  source 1..14: mol_type = other DNA
agggaccagggtaa

SEQ ID NO: 4512 - DNA, 14 bp, synthetic construct
  source 1..14: mol_type = other DNA
cagcctacgaggca

SEQ ID NO: 4513 - DNA, 14 bp, synthetic construct
  source 1..14: mol_type = other DNA
acaccgaacgtgcc

SEQ ID NO: 4514 - DNA, 14 bp, synthetic construct
  source 1..14: mol_type = other DNA
accgaccaatgccc

SEQ ID NO: 4515 - DNA, 14 bp, synthetic construct
  source 1..14: mol_type = other DNA
ccacgacggtacga

SEQ ID NO: 4516 - DNA, 14 bp, synthetic construct
  source 1..14: mol_type = other DNA
atgcaaggaaaaca

SEQ ID NO: 4517 - DNA, 14 bp, synthetic construct
  source 1..14: mol_type = other DNA
gcagcgccactgcc

SEQ ID NO: 4518 - DNA, 14 bp, synthetic construct
  source 1..14: mol_type = other DNA
taccagagacgaga

SEQ ID NO: 4519 - DNA, 14 bp, synthetic construct
  source 1..14: mol_type = other DNA
ccatcaggagcaaa

SEQ ID NO: 4520 - DNA, 14 bp, synthetic construct
  source 1..14: mol_type = other DNA
gagcgatgggcggc

SEQ ID NO: 4521 - DNA, 14 bp, synthetic construct
  source 1..14: mol_type = other DNA
ccgcgatgcagcag

SEQ ID NO: 4522 - DNA, 14 bp, synthetic construct
  source 1..14: mol_type = other DNA
aaagcaccgatcga

SEQ ID NO: 4523 - DNA, 14 bp, synthetic construct
  source 1..14: mol_type = other DNA
cccaaatgcgggcc

SEQ ID NO: 4524 - DNA, 14 bp, synthetic construct
  source 1..14: mol_type = other DNA
cagcccaatccggc

SEQ ID NO: 4525 - DNA, 14 bp, synthetic construct
  source 1..14: mol_type = other DNA
agaacgagtaacca

SEQ ID NO: 4526 - DNA, 14 bp, synthetic construct
  source 1..14: mol_type = other DNA
agggcgaaacacta

SEQ ID NO: 4527 - DNA, 14 bp, synthetic construct
  source 1..14: mol_type = other DNA
cgatcagcgggaca

SEQ ID NO: 4528 - DNA, 14 bp, synthetic construct
  source 1..14: mol_type = other DNA
ggcctaaggcagga

SEQ ID NO: 4529 - DNA, 14 bp, synthetic construct
  source 1..14: mol_type = other DNA
ccaatacagagacg

SEQ ID NO: 4530 - DNA, 14 bp, synthetic construct
  source 1..14: mol_type = other DNA
gaaaaggcgaaata

SEQ ID NO: 4531 - DNA, 14 bp, synthetic construct
  source 1..14: mol_type = other DNA
aatgaacgagacac

SEQ ID NO: 4532 - DNA, 14 bp, synthetic construct
  source 1..14: mol_type = other DNA
gctcaaacagccac

SEQ ID NO: 4533 - DNA, 14 bp, synthetic construct
  source 1..14: mol_type = other DNA
aagcgcgacgaact

SEQ ID NO: 4534 - DNA, 14 bp, synthetic construct
  source 1..14: mol_type = other DNA
cgcaagaataacga

SEQ ID NO: 4535 - DNA, 14 bp, synthetic construct
  source 1..14: mol_type = other DNA
agagccgtggggag

SEQ ID NO: 4536 - DNA, 14 bp, synthetic construct
  source 1..14: mol_type = other DNA
ggacccacgcagtc

SEQ ID NO: 4537 - DNA, 14 bp, synthetic construct
  source 1..14: mol_type = other DNA
accgtagccaaagg

SEQ ID NO: 4538 - DNA, 14 bp, synthetic construct
  source 1..14: mol_type = other DNA
gaacgcacgggctc

SEQ ID NO: 4539 - DNA, 14 bp, synthetic construct
  source 1..14: mol_type = other DNA
atgcacaggccagg

SEQ ID NO: 4540 - DNA, 14 bp, synthetic construct
  source 1..14: mol_type = other DNA
aggcaaaagcatgg

SEQ ID NO: 4541 - DNA, 14 bp, synthetic construct
  source 1..14: mol_type = other DNA
taccgaggcgggga

SEQ ID NO: 4542 - DNA, 14 bp, synthetic construct
  source 1..14: mol_type = other DNA
ggacgatggcacaa

SEQ ID NO: 4543 - DNA, 14 bp, synthetic construct
  source 1..14: mol_type = other DNA
agagcatagcggaa

SEQ ID NO: 4544 - DNA, 14 bp, synthetic construct
  source 1..14: mol_type = other DNA
agccggacacccta

SEQ ID NO: 4545 - DNA, 14 bp, synthetic construct
  source 1..14: mol_type = other DNA
aatagaggacaggg

SEQ ID NO: 4546 - DNA, 14 bp, synthetic construct
  source 1..14: mol_type = other DNA
ctggcgacgaccag

SEQ ID NO: 4547 - DNA, 14 bp, synthetic construct
  source 1..14: mol_type = other DNA
cgcaacgctgccga

SEQ ID NO: 4548 - DNA, 14 bp, synthetic construct
  source 1..14: mol_type = other DNA
accgcgatgcgccc

SEQ ID NO: 4549 - DNA, 14 bp, synthetic construct
  source 1..14: mol_type = other DNA
ccgcagcagcgatc

SEQ ID NO: 4550 - DNA, 14 bp, synthetic construct
  source 1..14: mol_type = other DNA
ggatgagacacccc

SEQ ID NO: 4551 - DNA, 14 bp, synthetic construct
  source 1..14: mol_type = other DNA
caccgtaacacccc

SEQ ID NO: 4552 - DNA, 14 bp, synthetic construct
  source 1..14: mol_type = other DNA
gcgtcgcggaacac

SEQ ID NO: 4553 - DNA, 14 bp, synthetic construct
  source 1..14: mol_type = other DNA
gcccgaacagatcc

SEQ ID NO: 4554 - DNA, 14 bp, synthetic construct
  source 1..14: mol_type = other DNA
agggaagagctaaa

SEQ ID NO: 4555 - DNA, 14 bp, synthetic construct
  source 1..14: mol_type = other DNA
acgaacctaaacag

SEQ ID NO: 4556 - DNA, 14 bp, synthetic construct
  source 1..14: mol_type = other DNA
gaagcacgcgagtg

SEQ ID NO: 4557 - DNA, 14 bp, synthetic construct
  source 1..14: mol_type = other DNA
acggaaacaggctg

SEQ ID NO: 4558 - DNA, 14 bp, synthetic construct
  source 1..14: mol_type = other DNA
aacatagggaaaag

SEQ ID NO: 4559 - DNA, 14 bp, synthetic construct
  source 1..14: mol_type = other DNA
gcgagagacgtagg

SEQ ID NO: 4560 - DNA, 14 bp, synthetic construct
  source 1..14: mol_type = other DNA
gagtacggaagcca

SEQ ID NO: 4561 - DNA, 14 bp, synthetic construct
  source 1..14: mol_type = other DNA
gatcacagaaagag

SEQ ID NO: 4562 - DNA, 14 bp, synthetic construct
  source 1..14: mol_type = other DNA
gaagggctggggcc

SEQ ID NO: 4563 - DNA, 14 bp, synthetic construct
  source 1..14: mol_type = other DNA
ccaggagccgtaag

SEQ ID NO: 4564 - DNA, 14 bp, synthetic construct
  source 1..14: mol_type = other DNA
agactcgccaggca

SEQ ID NO: 4565 - DNA, 14 bp, synthetic construct
  source 1..14: mol_type = other DNA
ggacagtccccacc

SEQ ID NO: 4566 - DNA, 14 bp, synthetic construct
  source 1..14: mol_type = other DNA
gcgccaccgagtga

SEQ ID NO: 4567 - DNA, 14 bp, synthetic construct
  source 1..14: mol_type = other DNA
gcagcccagaactc

SEQ ID NO: 4568 - DNA, 14 bp, synthetic construct
  source 1..14: mol_type = other DNA
acaggaagtcaccc

SEQ ID NO: 4569 - DNA, 14 bp, synthetic construct
  source 1..14: mol_type = other DNA
actagcccaacagg

SEQ ID NO: 4570 - DNA, 14 bp, synthetic construct
  source 1..14: mol_type = other DNA
ggccaagagcataa

SEQ ID NO: 4571 - DNA, 14 bp, synthetic construct
  source 1..14: mol_type = other DNA
cacaaaagaaatag

SEQ ID NO: 4572 - DNA, 14 bp, synthetic construct
  source 1..14: mol_type = other DNA
tgagcggaagacag

SEQ ID NO: 4573 - DNA, 14 bp, synthetic construct
  source 1..14: mol_type = other DNA
cgaagaaaccactg

SEQ ID NO: 4574 - DNA, 14 bp, synthetic construct
  source 1..14: mol_type = other DNA
cggaatgaagcaga

SEQ ID NO: 4575 - DNA, 14 bp, synthetic construct
  source 1..14: mol_type = other DNA
acccgtgagacccg

SEQ ID NO: 4576 - DNA, 14 bp, synthetic construct
  source 1..14: mol_type = other DNA
tacccgcaacagcg

SEQ ID NO: 4577 - DNA, 14 bp, synthetic construct
  source 1..14: mol_type = other DNA
taaccgggcggcac

SEQ ID NO: 4578 - DNA, 14 bp, synthetic construct
  source 1..14: mol_type = other DNA
gagaaaccctcgac

SEQ ID NO: 4579 - DNA, 14 bp, synthetic construct
  source 1..14: mol_type = other DNA
acggcaaggaatga

SEQ ID NO: 4580 - DNA, 14 bp, synthetic construct
  source 1..14: mol_type = other DNA
gagaatacaccccc

SEQ ID NO: 4581 - DNA, 14 bp, synthetic construct
  source 1..14: mol_type = other DNA
agggtccaggcacg

SEQ ID NO: 4582 - DNA, 14 bp, synthetic construct
  source 1..14: mol_type = other DNA
gggtaagcaagggg

SEQ ID NO: 4583 - DNA, 14 bp, synthetic construct
  source 1..14: mol_type = other DNA
catggagggcgagg

SEQ ID NO: 4584 - DNA, 14 bp, synthetic construct
  source 1..14: mol_type = other DNA
ggaccgaaacgtcg

SEQ ID NO: 4585 - DNA, 14 bp, synthetic construct
  source 1..14: mol_type = other DNA
cgaccaagctacgg

SEQ ID NO: 4586 - DNA, 14 bp, synthetic construct
  source 1..14: mol_type = other DNA
cggaaagtggagga

SEQ ID NO: 4587 - DNA, 14 bp, synthetic construct
  source 1..14: mol_type = other DNA
ccagggaccgtgga

SEQ ID NO: 4588 - DNA, 14 bp, synthetic construct
  source 1..14: mol_type = other DNA
ccgacgctggaacc

SEQ ID NO: 4589 - DNA, 14 bp, synthetic construct
  source 1..14: mol_type = other DNA
ataaaagaaacccg

SEQ ID NO: 4590 - DNA, 14 bp, synthetic construct
  source 1..14: mol_type = other DNA
gggagacacataaa

SEQ ID NO: 4591 - DNA, 14 bp, synthetic construct
  source 1..14: mol_type = other DNA
gcgcgtacacccag

SEQ ID NO: 4592 - DNA, 14 bp, synthetic construct
  source 1..14: mol_type = other DNA
aggaccataaaccc

SEQ ID NO: 4593 - DNA, 14 bp, synthetic construct
  source 1..14: mol_type = other DNA
ggggtacgccagca

SEQ ID NO: 4594 - DNA, 14 bp, synthetic construct
  source 1..14: mol_type = other DNA
aggcccaagagcct

SEQ ID NO: 4595 - DNA, 14 bp, synthetic construct
  source 1..14: mol_type = other DNA
cggaatgagaagcg

SEQ ID NO: 4596 - DNA, 14 bp, synthetic construct
  source 1..14: mol_type = other DNA
atgccgaggcacgc

SEQ ID NO: 4597 - DNA, 14 bp, synthetic construct
  source 1..14: mol_type = other DNA
gggaaaataagaac

SEQ ID NO: 4598 - DNA, 14 bp, synthetic construct
  source 1..14: mol_type = other DNA
cagcgcaagactac

SEQ ID NO: 4599 - DNA, 14 bp, synthetic construct
  source 1..14: mol_type = other DNA
ccggtccatgacac

SEQ ID NO: 4600 - DNA, 14 bp, synthetic construct
  source 1..14: mol_type = other DNA
ccgtcgaatcggca

SEQ ID NO: 4601 - DNA, 14 bp, synthetic construct
  source 1..14: mol_type = other DNA
ccgagtaacgctgc

SEQ ID NO: 4602 - DNA, 14 bp, synthetic construct
  source 1..14: mol_type = other DNA
ccgctgatggacgg

SEQ ID NO: 4603 - DNA, 14 bp, synthetic construct
  source 1..14: mol_type = other DNA
cggtgtaaccgcag

SEQ ID NO: 4604 - DNA, 14 bp, synthetic construct
  source 1..14: mol_type = other DNA
tgcaccgagctgag

SEQ ID NO: 4605 - DNA, 14 bp, synthetic construct
  source 1..14: mol_type = other DNA
acgtggcctgcaaa

SEQ ID NO: 4606 - DNA, 14 bp, synthetic construct
  source 1..14: mol_type = other DNA
cgcccacacttgac

SEQ ID NO: 4607 - DNA, 14 bp, synthetic construct
  source 1..14: mol_type = other DNA
acaactatccgaac

SEQ ID NO: 4608 - DNA, 14 bp, synthetic construct
  source 1..14: mol_type = other DNA
tgactacgacccac

SEQ ID NO: 4609 - DNA, 14 bp, synthetic construct
  source 1..14: mol_type = other DNA
cgcgcagctcatac

SEQ ID NO: 4610 - DNA, 14 bp, synthetic construct
  source 1..14: mol_type = other DNA
cctcgaggtcagag

SEQ ID NO: 4611 - DNA, 14 bp, synthetic construct
  source 1..14: mol_type = other DNA
tgcctccaggaccg

SEQ ID NO: 4612 - DNA, 14 bp, synthetic construct
  source 1..14: mol_type = other DNA
atgccgaggtggca

SEQ ID NO: 4613 - DNA, 14 bp, synthetic construct
  source 1..14: mol_type = other DNA
gagtatcgccaagg

SEQ ID NO: 4614 - DNA, 14 bp, synthetic construct
  source 1..14: mol_type = other DNA
gcatctcgccccaa

SEQ ID NO: 4615 - DNA, 14 bp, synthetic construct
  source 1..14: mol_type = other DNA
gaggatcgatggcg

SEQ ID NO: 4616 - DNA, 14 bp, synthetic construct
  source 1..14: mol_type = other DNA
acataagtggaaaa

SEQ ID NO: 4617 - DNA, 14 bp, synthetic construct
  source 1..14: mol_type = other DNA
acgacagcgagtat

SEQ ID NO: 4618 - DNA, 14 bp, synthetic construct
  source 1..14: mol_type = other DNA
ccgacaccctcctg

SEQ ID NO: 4619 - DNA, 14 bp, synthetic construct
  source 1..14: mol_type = other DNA
atcccacgtcacca

SEQ ID NO: 4620 - DNA, 14 bp, synthetic construct
  source 1..14: mol_type = other DNA
agaaccacccgttc

SEQ ID NO: 4621 - DNA, 14 bp, synthetic construct
  source 1..14: mol_type = other DNA
acacagagctctgg

SEQ ID NO: 4622 - DNA, 14 bp, synthetic construct
  source 1..14: mol_type = other DNA
gaaaaacttaaggg

SEQ ID NO: 4623 - DNA, 14 bp, synthetic construct
  source 1..14: mol_type = other DNA
gggacgccgataat

SEQ ID NO: 4624 - DNA, 14 bp, synthetic construct
  source 1..14: mol_type = other DNA
cgaactcagtagcc

SEQ ID NO: 4625 - DNA, 14 bp, synthetic construct
  source 1..14: mol_type = other DNA
gctaacatccagcg

SEQ ID NO: 4626 - DNA, 14 bp, synthetic construct
  source 1..14: mol_type = other DNA
tgcccaggtaaagg

SEQ ID NO: 4627 - DNA, 14 bp, synthetic construct
  source 1..14: mol_type = other DNA
atataggaaccgcc

SEQ ID NO: 4628 - DNA, 14 bp, synthetic construct
  source 1..14: mol_type = other DNA
gagctgggatgcgc

SEQ ID NO: 4629 - DNA, 14 bp, synthetic construct
  source 1..14: mol_type = other DNA
atgcgtcgccaaga

SEQ ID NO: 4630 - DNA, 14 bp, synthetic construct
  source 1..14: mol_type = other DNA
ggaatgcctaagaa

SEQ ID NO: 4631 - DNA, 14 bp, synthetic construct
  source 1..14: mol_type = other DNA
aaacgcccagtata

SEQ ID NO: 4632 - DNA, 14 bp, synthetic construct
  source 1..14: mol_type = other DNA
actaccgcacgtaa

SEQ ID NO: 4633 - DNA, 14 bp, synthetic construct
  source 1..14: mol_type = other DNA
ccggtgagaggtaa

SEQ ID NO: 4634 - DNA, 14 bp, synthetic construct
  source 1..14: mol_type = other DNA
tcggcctcacacgc

SEQ ID NO: 4635 - DNA, 14 bp, synthetic construct
  source 1..14: mol_type = other DNA
catgaaaagcacct

SEQ ID NO: 4636 - DNA, 14 bp, synthetic construct
  source 1..14: mol_type = other DNA
gcatgcagggtagc

SEQ ID NO: 4637 - DNA, 14 bp, synthetic construct
  source 1..14: mol_type = other DNA
tacgctgggaagca

SEQ ID NO: 4638 - DNA, 14 bp, synthetic construct
  source 1..14: mol_type = other DNA
actaccaaggatca

SEQ ID NO: 4639 - DNA, 14 bp, synthetic construct
  source 1..14: mol_type = other DNA
tacgagtaagggcc

SEQ ID NO: 4640 - DNA, 14 bp, synthetic construct
  source 1..14: mol_type = other DNA
gtcctacaacacag

SEQ ID NO: 4641 - DNA, 14 bp, synthetic construct
  source 1..14: mol_type = other DNA
gtcacaagacctcg

SEQ ID NO: 4642 - DNA, 14 bp, synthetic construct
  source 1..14: mol_type = other DNA
tacggcaggcacgt

SEQ ID NO: 4643 - DNA, 14 bp, synthetic construct
  source 1..14: mol_type = other DNA
ccgagcatacctgg

SEQ ID NO: 4644 - DNA, 14 bp, synthetic construct
  source 1..14: mol_type = other DNA
aagctgtggagcca

SEQ ID NO: 4645 - DNA, 14 bp, synthetic construct
  source 1..14: mol_type = other DNA
atgggggagctgca

SEQ ID NO: 4646 - DNA, 14 bp, synthetic construct
  source 1..14: mol_type = other DNA
aagggacgtcatag

SEQ ID NO: 4647 - DNA, 14 bp, synthetic construct
  source 1..14: mol_type = other DNA
gtggagaaccggta

SEQ ID NO: 4648 - DNA, 14 bp, synthetic construct
  source 1..14: mol_type = other DNA
cgtactaacggacc

SEQ ID NO: 4649 - DNA, 14 bp, synthetic construct
  source 1..14: mol_type = other DNA
ccgtaatagaaccc

SEQ ID NO: 4650 - DNA, 14 bp, synthetic construct
  source 1..14: mol_type = other DNA
gtgaacatgcgcgg

SEQ ID NO: 4651 - DNA, 14 bp, synthetic construct
  source 1..14: mol_type = other DNA
gcaaaaggtgagtg

SEQ ID NO: 4652 - DNA, 14 bp, synthetic construct
  source 1..14: mol_type = other DNA
ggaccgcactctca

SEQ ID NO: 4653 - DNA, 14 bp, synthetic construct
  source 1..14: mol_type = other DNA
aacagcacctacta

SEQ ID NO: 4654 - DNA, 14 bp, synthetic construct
  source 1..14: mol_type = other DNA
gcagatcatagggg

SEQ ID NO: 4655 - DNA, 14 bp, synthetic construct
  source 1..14: mol_type = other DNA
gcgccttcgcacga

SEQ ID NO: 4656 - DNA, 14 bp, synthetic construct
  source 1..14: mol_type = other DNA
aatgtggcacgaca

SEQ ID NO: 4657 - DNA, 14 bp, synthetic construct
  source 1..14: mol_type = other DNA
aaaaagcgtgcatg

SEQ ID NO: 4658 - DNA, 14 bp, synthetic construct
  source 1..14: mol_type = other DNA
accgataaagatac

SEQ ID NO: 4659 - DNA, 14 bp, synthetic construct
  source 1..14: mol_type = other DNA
ccgcactagagact

SEQ ID NO: 4660 - DNA, 14 bp, synthetic construct
  source 1..14: mol_type = other DNA
gccactgtacgcac

SEQ ID NO: 4661 - DNA, 14 bp, synthetic construct
  source 1..14: mol_type = other DNA
gcgctggcgaacgt

SEQ ID NO: 4662 - DNA, 14 bp, synthetic construct
  source 1..14: mol_type = other DNA
gctcccggataaca

SEQ ID NO: 4663 - DNA, 14 bp, synthetic construct
  source 1..14: mol_type = other DNA
aacctggtccagaa

SEQ ID NO: 4664 - DNA, 14 bp, synthetic construct
  source 1..14: mol_type = other DNA
cttaccagcagccg

SEQ ID NO: 4665 - DNA, 14 bp, synthetic construct
  source 1..14: mol_type = other DNA
ctgccaaggcagta

SEQ ID NO: 4666 - DNA, 14 bp, synthetic construct
  source 1..14: mol_type = other DNA
aaagccttaggcac

SEQ ID NO: 4667 - DNA, 14 bp, synthetic construct
  source 1..14: mol_type = other DNA
ggaattgccgcagg

SEQ ID NO: 4668 - DNA, 14 bp, synthetic construct
  source 1..14: mol_type = other DNA
acgataagtggaaa

SEQ ID NO: 4669 - DNA, 14 bp, synthetic construct
  source 1..14: mol_type = other DNA
cggcaagtaatcgg

SEQ ID NO: 4670 - DNA, 14 bp, synthetic construct
  source 1..14: mol_type = other DNA
ctacggaacgggat

SEQ ID NO: 4671 - DNA, 14 bp, synthetic construct
  source 1..14: mol_type = other DNA
cccggaatagctac

SEQ ID NO: 4672 - DNA, 14 bp, synthetic construct
  source 1..14: mol_type = other DNA
cctcaccgagtccc

SEQ ID NO: 4673 - DNA, 14 bp, synthetic construct
  source 1..14: mol_type = other DNA
ccggagtaagctag

SEQ ID NO: 4674 - DNA, 14 bp, synthetic construct
  source 1..14: mol_type = other DNA
tagaacggaatcgc

SEQ ID NO: 4675 - DNA, 14 bp, synthetic construct
  source 1..14: mol_type = other DNA
aatcgggcggcgat

SEQ ID NO: 4676 - DNA, 14 bp, synthetic construct
  source 1..14: mol_type = other DNA
cgaagccgtcaatc

SEQ ID NO: 4677 - DNA, 14 bp, synthetic construct
  source 1..14: mol_type = other DNA
agcggaagcagatt

SEQ ID NO: 4678 - DNA, 14 bp, synthetic construct
  source 1..14: mol_type = other DNA
cagtgtgggcacga

SEQ ID NO: 4679 - DNA, 14 bp, synthetic construct
  source 1..14: mol_type = other DNA
cgtgacgggtgccc

SEQ ID NO: 4680 - DNA, 14 bp, synthetic construct
  source 1..14: mol_type = other DNA
gtaagaaagctcga

SEQ ID NO: 4681 - DNA, 14 bp, synthetic construct
  source 1..14: mol_type = other DNA
agactactagcagc

SEQ ID NO: 4682 - DNA, 14 bp, synthetic construct
  source 1..14: mol_type = other DNA
cagcgctatggacg

SEQ ID NO: 4683 - DNA, 14 bp, synthetic construct
  source 1..14: mol_type = other DNA
tggagtagagaacc

SEQ ID NO: 4684 - DNA, 14 bp, synthetic construct
  source 1..14: mol_type = other DNA
aatacacgggacta

SEQ ID NO: 4685 - DNA, 14 bp, synthetic construct
  source 1..14: mol_type = other DNA
gaacccggtagggt

SEQ ID NO: 4686 - DNA, 14 bp, synthetic construct
  source 1..14: mol_type = other DNA
ttcacaaagggggg

SEQ ID NO: 4687 - DNA, 14 bp, synthetic construct
  source 1..14: mol_type = other DNA
aggaggcctcagat

SEQ ID NO: 4688 - DNA, 14 bp, synthetic construct
  source 1..14: mol_type = other DNA
ccgagccgtggtcg

SEQ ID NO: 4689 - DNA, 14 bp, synthetic construct
  source 1..14: mol_type = other DNA
cgaatgaatgggac

SEQ ID NO: 4690 - DNA, 14 bp, synthetic construct
  source 1..14: mol_type = other DNA
ccacaggttacccg

SEQ ID NO: 4691 - DNA, 14 bp, synthetic construct
  source 1..14: mol_type = other DNA
gtcgcacaaatgcc

SEQ ID NO: 4692 - DNA, 14 bp, synthetic construct
  source 1..14: mol_type = other DNA
gcgctaagaaaact

SEQ ID NO: 4693 - DNA, 14 bp, synthetic construct
  source 1..14: mol_type = other DNA
tcgtgccccaagga

SEQ ID NO: 4694 - DNA, 14 bp, synthetic construct
  source 1..14: mol_type = other DNA
ttgcacccaggaga

SEQ ID NO: 4695 - DNA, 14 bp, synthetic construct
  source 1..14: mol_type = other DNA
cggacgagtaaggt

SEQ ID NO: 4696 - DNA, 14 bp, synthetic construct
  source 1..14: mol_type = other DNA
gaatcaggggaggt

SEQ ID NO: 4697 - DNA, 14 bp, synthetic construct
  source 1..14: mol_type = other DNA
caagcatccaatac

SEQ ID NO: 4698 - DNA, 14 bp, synthetic construct
  source 1..14: mol_type = other DNA
acactcgtgcacag

SEQ ID NO: 4699 - DNA, 14 bp, synthetic construct
  source 1..14: mol_type = other DNA
caggcgtgcgtgac

SEQ ID NO: 4700 - DNA, 14 bp, synthetic construct
  source 1..14: mol_type = other DNA
aggtccggacgtga

SEQ ID NO: 4701 - DNA, 14 bp, synthetic construct
  source 1..14: mol_type = other DNA
gctcgcccaggtgc

SEQ ID NO: 4702 - DNA, 14 bp, synthetic construct
  source 1..14: mol_type = other DNA
gatcctcccaaggg

SEQ ID NO: 4703 - DNA, 14 bp, synthetic construct
  source 1..14: mol_type = other DNA
cgtgcgcagaaata

SEQ ID NO: 4704 - DNA, 14 bp, synthetic construct
  source 1..14: mol_type = other DNA
tagtaaccgaaaca

SEQ ID NO: 4705 - DNA, 14 bp, synthetic construct
  source 1..14: mol_type = other DNA
taatgggcacagag

SEQ ID NO: 4706 - DNA, 14 bp, synthetic construct
  source 1..14: mol_type = other DNA
aactccgaccacat

SEQ ID NO: 4707 - DNA, 14 bp, synthetic construct
  source 1..14: mol_type = other DNA
cgccaggtggcatg

SEQ ID NO: 4708 - DNA, 14 bp, synthetic construct
  source 1..14: mol_type = other DNA
actcggagtacaac

SEQ ID NO: 4709 - DNA, 14 bp, synthetic construct
  source 1..14: mol_type = other DNA
gcctataagagcac

SEQ ID NO: 4710 - DNA, 14 bp, synthetic construct
  source 1..14: mol_type = other DNA
gcaggaggatgtac

SEQ ID NO: 4711 - DNA, 14 bp, synthetic construct
  source 1..14: mol_type = other DNA
tcatacggacaaga

SEQ ID NO: 4712 - DNA, 14 bp, synthetic construct
  source 1..14: mol_type = other DNA
aacgcgctgtgcgg

SEQ ID NO: 4713 - DNA, 14 bp, synthetic construct
  source 1..14: mol_type = other DNA
aactcagcgatcac

SEQ ID NO: 4714 - DNA, 14 bp, synthetic construct
  source 1..14: mol_type = other DNA
ccccagtaaatgcc

SEQ ID NO: 4715 - DNA, 14 bp, synthetic construct
  source 1..14: mol_type = other DNA
taacgagaaaacat

SEQ ID NO: 4716 - DNA, 14 bp, synthetic construct
  source 1..14: mol_type = other DNA
cccctcgggtcaac

SEQ ID NO: 4717 - DNA, 14 bp, synthetic construct
  source 1..14: mol_type = other DNA
cgactctcaaccac

SEQ ID NO: 4718 - DNA, 14 bp, synthetic construct
  source 1..14: mol_type = other DNA
cctaggggcagtgc

SEQ ID NO: 4719 - DNA, 14 bp, synthetic construct
  source 1..14: mol_type = other DNA
cgcagggtggaaat

SEQ ID NO: 4720 - DNA, 14 bp, synthetic construct
  source 1..14: mol_type = other DNA
tagccccaccatgg

SEQ ID NO: 4721 - DNA, 14 bp, synthetic construct
  source 1..14: mol_type = other DNA
gacgaaggttgacg

SEQ ID NO: 4722 - DNA, 14 bp, synthetic construct
  source 1..14: mol_type = other DNA
gtagagggactcga

SEQ ID NO: 4723 - DNA, 14 bp, synthetic construct
  source 1..14: mol_type = other DNA
acctgccgagtaag

SEQ ID NO: 4724 - DNA, 14 bp, synthetic construct
  source 1..14: mol_type = other DNA
cgctaacgtacagc

SEQ ID NO: 4725 - DNA, 14 bp, synthetic construct
  source 1..14: mol_type = other DNA
agcggatgcgctcc

SEQ ID NO: 4726 - DNA, 14 bp, synthetic construct
  source 1..14: mol_type = other DNA
actaccaccacaat

SEQ ID NO: 4727 - DNA, 14 bp, synthetic construct
  source 1..14: mol_type = other DNA
tggacggaaacgat

SEQ ID NO: 4728 - DNA, 14 bp, synthetic construct
  source 1..14: mol_type = other DNA
gccaactacactgg

SEQ ID NO: 4729 - DNA, 14 bp, synthetic construct
  source 1..14: mol_type = other DNA
ccctcgactaaccg

SEQ ID NO: 4730 - DNA, 14 bp, synthetic construct
  source 1..14: mol_type = other DNA
aatccagctaacgg

SEQ ID NO: 4731 - DNA, 14 bp, synthetic construct
  source 1..14: mol_type = other DNA
ctgaaggcgagcat

SEQ ID NO: 4732 - DNA, 14 bp, synthetic construct
  source 1..14: mol_type = other DNA
cggccaatcacgtc

SEQ ID NO: 4733 - DNA, 14 bp, synthetic construct
  source 1..14: mol_type = other DNA
acctcgctcgccgc

SEQ ID NO: 4734 - DNA, 14 bp, synthetic construct
  source 1..14: mol_type = other DNA
ggggcacataatca

SEQ ID NO: 4735 - DNA, 14 bp, synthetic construct
  source 1..14: mol_type = other DNA
cggtacaccaaggt

SEQ ID NO: 4736 - DNA, 14 bp, synthetic construct
  source 1..14: mol_type = other DNA
ctcccatgcgaaca

SEQ ID NO: 4737 - DNA, 14 bp, synthetic construct
  source 1..14: mol_type = other DNA
ggagatgaaatgac

SEQ ID NO: 4738 - DNA, 14 bp, synthetic construct
  source 1..14: mol_type = other DNA
taaaaatcgcagaa

SEQ ID NO: 4739 - DNA, 14 bp, synthetic construct
  source 1..14: mol_type = other DNA
aatgaaagtagaaa

SEQ ID NO: 4740 - DNA, 14 bp, synthetic construct
  source 1..14: mol_type = other DNA
gtatgaagcgcgca

SEQ ID NO: 4741 - DNA, 14 bp, synthetic construct
  source 1..14: mol_type = other DNA
tagggcctaagaag

SEQ ID NO: 4742 - DNA, 14 bp, synthetic construct
  source 1..14: mol_type = other DNA
ggatgcgtacgccc

SEQ ID NO: 4743 - DNA, 14 bp, synthetic construct
  source 1..14: mol_type = other DNA
aaggacgtatacgg

SEQ ID NO: 4744 - DNA, 14 bp, synthetic construct
  source 1..14: mol_type = other DNA
ccgaagggctcatg

SEQ ID NO: 4745 - DNA, 14 bp, synthetic construct
  source 1..14: mol_type = other DNA
gtactgagcaacgg

SEQ ID NO: 4746 - DNA, 14 bp, synthetic construct
  source 1..14: mol_type = other DNA
catgaaatccggca

SEQ ID NO: 4747 - DNA, 14 bp, synthetic construct
  source 1..14: mol_type = other DNA
cgtataaacgaaga

SEQ ID NO: 4748 - DNA, 14 bp, synthetic construct
  source 1..14: mol_type = other DNA
agtaactgaggacg

SEQ ID NO: 4749 - DNA, 14 bp, synthetic construct
  source 1..14: mol_type = other DNA
cgacgcgtccgtgc

SEQ ID NO: 4750 - DNA, 14 bp, synthetic construct
  source 1..14: mol_type = other DNA
cctaccccaaacta

SEQ ID NO: 4751 - DNA, 14 bp, synthetic construct
  source 1..14: mol_type = other DNA
gagtgcagagtgcc

SEQ ID NO: 4752 - DNA, 14 bp, synthetic construct
  source 1..14: mol_type = other DNA
aaagtcggcagctg

SEQ ID NO: 4753 - DNA, 14 bp, synthetic construct
  source 1..14: mol_type = other DNA
tccggcatgaggcg

SEQ ID NO: 4754 - DNA, 14 bp, synthetic construct
  source 1..14: mol_type = other DNA
gtcgggaagaggtc

SEQ ID NO: 4755 - DNA, 14 bp, synthetic construct
  source 1..14: mol_type = other DNA
cctgtacgaaacgg

SEQ ID NO: 4756 - DNA, 14 bp, synthetic construct
  source 1..14: mol_type = other DNA
tggaggccaatacg

SEQ ID NO: 4757 - DNA, 14 bp, synthetic construct
  source 1..14: mol_type = other DNA
atgcacccggagat

SEQ ID NO: 4758 - DNA, 14 bp, synthetic construct
  source 1..14: mol_type = other DNA
ctcgccagcatcga

SEQ ID NO: 4759 - DNA, 14 bp, synthetic construct
  source 1..14: mol_type = other DNA
tgctccgacgggcc

SEQ ID NO: 4760 - DNA, 14 bp, synthetic construct
  source 1..14: mol_type = other DNA
gtacgggtcgaaac

SEQ ID NO: 4761 - DNA, 14 bp, synthetic construct
  source 1..14: mol_type = other DNA
gaaggagacgtata

SEQ ID NO: 4762 - DNA, 14 bp, synthetic construct
  source 1..14: mol_type = other DNA
ctcacgccgagtcg

SEQ ID NO: 4763 - DNA, 14 bp, synthetic construct
  source 1..14: mol_type = other DNA
aagcaatgcgatca

SEQ ID NO: 4764 - DNA, 14 bp, synthetic construct
  source 1..14: mol_type = other DNA
gaggtcaatcgacc

SEQ ID NO: 4765 - DNA, 14 bp, synthetic construct
  source 1..14: mol_type = other DNA
aggacgtaccaatc

SEQ ID NO: 4766 - DNA, 14 bp, synthetic construct
  source 1..14: mol_type = other DNA
cgtccagcataggg

SEQ ID NO: 4767 - DNA, 14 bp, synthetic construct
  source 1..14: mol_type = other DNA
cagcaaactgcatc

SEQ ID NO: 4768 - DNA, 14 bp, synthetic construct
  source 1..14: mol_type = other DNA
tgggtacggggaca

SEQ ID NO: 4769 - DNA, 14 bp, synthetic construct
  source 1..14: mol_type = other DNA
actacactaccgcc

SEQ ID NO: 4770 - DNA, 14 bp, synthetic construct
  source 1..14: mol_type = other DNA
cgtccgcaactcgc

SEQ ID NO: 4771 - DNA, 14 bp, synthetic construct
  source 1..14: mol_type = other DNA
ggccactagatggg

SEQ ID NO: 4772 - DNA, 14 bp, synthetic construct
  source 1..14: mol_type = other DNA
ctgagcgctcccgg

SEQ ID NO: 4773 - DNA, 14 bp, synthetic construct
  source 1..14: mol_type = other DNA
aagcgtcagccctc

SEQ ID NO: 4774 - DNA, 14 bp, synthetic construct
  source 1..14: mol_type = other DNA
catagccacctcga

SEQ ID NO: 4775 - DNA, 14 bp, synthetic construct
  source 1..14: mol_type = other DNA
gactgacatccaag

SEQ ID NO: 4776 - DNA, 14 bp, synthetic construct
  source 1..14: mol_type = other DNA
tacagacagataac

SEQ ID NO: 4777 - DNA, 14 bp, synthetic construct
  source 1..14: mol_type = other DNA
gcaactatcagcgg

SEQ ID NO: 4778 - DNA, 14 bp, synthetic construct
  source 1..14: mol_type = other DNA
tgcggacatagacc

SEQ ID NO: 4779 - DNA, 14 bp, synthetic construct
  source 1..14: mol_type = other DNA
cgaagcatgaaact

SEQ ID NO: 4780 - DNA, 14 bp, synthetic construct
  source 1..14: mol_type = other DNA
caaacaaggaatta

SEQ ID NO: 4781 - DNA, 14 bp, synthetic construct
  source 1..14: mol_type = other DNA
ggaatatgcaacca

SEQ ID NO: 4782 - DNA, 14 bp, synthetic construct
  source 1..14: mol_type = other DNA
agcgcgaagtatcc

SEQ ID NO: 4783 - DNA, 14 bp, synthetic construct
  source 1..14: mol_type = other DNA
cttcgaaaacggaa

SEQ ID NO: 4784 - DNA, 14 bp, synthetic construct
  source 1..14: mol_type = other DNA
agggatcaagtcca

SEQ ID NO: 4785 - DNA, 14 bp, synthetic construct
  source 1..14: mol_type = other DNA
catagagtagcaag

SEQ ID NO: 4786 - DNA, 14 bp, synthetic construct
  source 1..14: mol_type = other DNA
ggctaagaaaccgt

SEQ ID NO: 4787 - DNA, 14 bp, synthetic construct
  source 1..14: mol_type = other DNA
gagcctaagataag

SEQ ID NO: 4788 - DNA, 14 bp, synthetic construct
  source 1..14: mol_type = other DNA
actccctagcgcac

SEQ ID NO: 4789 - DNA, 14 bp, synthetic construct
  source 1..14: mol_type = other DNA
ctggaccccctgcg

SEQ ID NO: 4790 - DNA, 14 bp, synthetic construct
  source 1..14: mol_type = other DNA
taacacgagactgg

SEQ ID NO: 4791 - DNA, 14 bp, synthetic construct
  source 1..14: mol_type = other DNA
cccataatcgggaa

SEQ ID NO: 4792 - DNA, 14 bp, synthetic construct
  source 1..14: mol_type = other DNA
cggtaagggtacgg

SEQ ID NO: 4793 - DNA, 14 bp, synthetic construct
  source 1..14: mol_type = other DNA
caatggcacgctag

SEQ ID NO: 4794 - DNA, 14 bp, synthetic construct
  source 1..14: mol_type = other DNA
gatagagtcccagc

SEQ ID NO: 4795 - DNA, 14 bp, synthetic construct
  source 1..14: mol_type = other DNA
catcctagacggac

SEQ ID NO: 4796 - DNA, 14 bp, synthetic construct
  source 1..14: mol_type = other DNA
ttacccaacacacg

SEQ ID NO: 4797 - DNA, 14 bp, synthetic construct
  source 1..14: mol_type = other DNA
ccaccagtatcacg

SEQ ID NO: 4798 - DNA, 14 bp, synthetic construct
  source 1..14: mol_type = other DNA
agcgaccgttcgaa

SEQ ID NO: 4799 - DNA, 14 bp, synthetic construct
  source 1..14: mol_type = other DNA
aaacacgttacgaa

SEQ ID NO: 4800 - DNA, 14 bp, synthetic construct
  source 1..14: mol_type = other DNA
gaaagccaggcatt

SEQ ID NO: 4801 - DNA, 14 bp, synthetic construct
  source 1..14: mol_type = other DNA
ggggctaagagtcc

SEQ ID NO: 4802 - DNA, 14 bp, synthetic construct
  source 1..14: mol_type = other DNA
acagaacgtcgtca

SEQ ID NO: 4803 - DNA, 14 bp, synthetic construct
  source 1..14: mol_type = other DNA
ggcgctcagctagc

SEQ ID NO: 4804 - DNA, 14 bp, synthetic construct
  source 1..14: mol_type = other DNA
atatacccggcgcc

SEQ ID NO: 4805 - DNA, 14 bp, synthetic construct
  source 1..14: mol_type = other DNA
gactacaggctccg

SEQ ID NO: 4806 - DNA, 14 bp, synthetic construct
  source 1..14: mol_type = other DNA
acgtactaaaggcc

SEQ ID NO: 4807 - DNA, 14 bp, synthetic construct
  source 1..14: mol_type = other DNA
aaccgccagtgtaa

SEQ ID NO: 4808 - DNA, 14 bp, synthetic construct
  source 1..14: mol_type = other DNA
cgacgtggcgtgca

SEQ ID NO: 4809 - DNA, 14 bp, synthetic construct
  source 1..14: mol_type = other DNA
tccagacgcccact

SEQ ID NO: 4810 - DNA, 14 bp, synthetic construct
  source 1..14: mol_type = other DNA
ctagggggtcaacc

SEQ ID NO: 4811 - DNA, 14 bp, synthetic construct
  source 1..14: mol_type = other DNA
cgatagaactaggg

SEQ ID NO: 4812 - DNA, 14 bp, synthetic construct
  source 1..14: mol_type = other DNA
cgaggtagcaaagt

SEQ ID NO: 4813 - DNA, 14 bp, synthetic construct
  source 1..14: mol_type = other DNA
gcggaaatcagact

SEQ ID NO: 4814 - DNA, 14 bp, synthetic construct
  source 1..14: mol_type = other DNA
acctcaggcctgac

SEQ ID NO: 4815 - DNA, 14 bp, synthetic construct
  source 1..14: mol_type = other DNA
ctaatagacaagcc

SEQ ID NO: 4816 - DNA, 14 bp, synthetic construct
  source 1..14: mol_type = other DNA
catgggcgaatgga

SEQ ID NO: 4817 - DNA, 14 bp, synthetic construct
  source 1..14: mol_type = other DNA
ccaagacctaatga

SEQ ID NO: 4818 - DNA, 14 bp, synthetic construct
  source 1..14: mol_type = other DNA
gagccgactgaact

SEQ ID NO: 4819 - DNA, 14 bp, synthetic construct
  source 1..14: mol_type = other DNA
taactgcaacgacc

SEQ ID NO: 4820 - DNA, 14 bp, synthetic construct
  source 1..14: mol_type = other DNA
gaacgatagtcacg

SEQ ID NO: 4821 - DNA, 14 bp, synthetic construct
  source 1..14: mol_type = other DNA
tagcgtggaaaaac

SEQ ID NO: 4822 - DNA, 14 bp, synthetic construct
  source 1..14: mol_type = other DNA
ccaccagacgcgtt

SEQ ID NO: 4823 - DNA, 14 bp, synthetic construct
  source 1..14: mol_type = other DNA
aaatgaagtaagaa

SEQ ID NO: 4824 - DNA, 14 bp, synthetic construct
  source 1..14: mol_type = other DNA
aagaacctatggca

SEQ ID NO: 4825 - DNA, 14 bp, synthetic construct
  source 1..14: mol_type = other DNA
cagtccgaccccta

SEQ ID NO: 4826 - DNA, 14 bp, synthetic construct
  source 1..14: mol_type = other DNA
gagagataggagtg

SEQ ID NO: 4827 - DNA, 14 bp, synthetic construct
  source 1..14: mol_type = other DNA
gctcaacagcgtgg

SEQ ID NO: 4828 - DNA, 14 bp, synthetic construct
  source 1..14: mol_type = other DNA
ggcaaagatataag

SEQ ID NO: 4829 - DNA, 14 bp, synthetic construct
  source 1..14: mol_type = other DNA
ctcccagatcgaga

SEQ ID NO: 4830 - DNA, 14 bp, synthetic construct
  source 1..14: mol_type = other DNA
ggactccgtgacaa

SEQ ID NO: 4831 - DNA, 14 bp, synthetic construct
  source 1..14: mol_type = other DNA
gcataatgccgcca

SEQ ID NO: 4832 - DNA, 14 bp, synthetic construct
  source 1..14: mol_type = other DNA
gggagtccgtggga

SEQ ID NO: 4833 - DNA, 14 bp, synthetic construct
  source 1..14: mol_type = other DNA
taacgacagctaca

SEQ ID NO: 4834 - DNA, 14 bp, synthetic construct
  source 1..14: mol_type = other DNA
aaaactcagacaat

SEQ ID NO: 4835 - DNA, 14 bp, synthetic construct
  source 1..14: mol_type = other DNA
atccccgacgcata

SEQ ID NO: 4836 - DNA, 14 bp, synthetic construct
  source 1..14: mol_type = other DNA
catgacgcaatacc

SEQ ID NO: 4837 - DNA, 14 bp, synthetic construct
  source 1..14: mol_type = other DNA
acactggcgactca

SEQ ID NO: 4838 - DNA, 14 bp, synthetic construct
  source 1..14: mol_type = other DNA
ccccgacgtagcgt

SEQ ID NO: 4839 - DNA, 14 bp, synthetic construct
  source 1..14: mol_type = other DNA
tcataagagaagga

SEQ ID NO: 4840 - DNA, 14 bp, synthetic construct
  source 1..14: mol_type = other DNA
ggatgcaaatccag

SEQ ID NO: 4841 - DNA, 14 bp, synthetic construct
  source 1..14: mol_type = other DNA
ggcaggctccatcg

SEQ ID NO: 4842 - DNA, 14 bp, synthetic construct
  source 1..14: mol_type = other DNA
agctaaaaggctga

SEQ ID NO: 4843 - DNA, 14 bp, synthetic construct
  source 1..14: mol_type = other DNA
attaacgagccgga

SEQ ID NO: 4844 - DNA, 14 bp, synthetic construct
  source 1..14: mol_type = other DNA
ttaagagaccacac

SEQ ID NO: 4845 - DNA, 14 bp, synthetic construct
  source 1..14: mol_type = other DNA
ggtatggaccggcg

SEQ ID NO: 4846 - DNA, 14 bp, synthetic construct
  source 1..14: mol_type = other DNA
taacgaaagtgagc

SEQ ID NO: 4847 - DNA, 14 bp, synthetic construct
  source 1..14: mol_type = other DNA
aagaattcgaccag

SEQ ID NO: 4848 - DNA, 14 bp, synthetic construct
  source 1..14: mol_type = other DNA
acccgcaccttgag

SEQ ID NO: 4849 - DNA, 14 bp, synthetic construct
  source 1..14: mol_type = other DNA
gtaagaggcaagat

SEQ ID NO: 4850 - DNA, 14 bp, synthetic construct
  source 1..14: mol_type = other DNA
aagccagattggaa

SEQ ID NO: 4851 - DNA, 14 bp, synthetic construct
  source 1..14: mol_type = other DNA
ggccttaacaacaa

SEQ ID NO: 4852 - DNA, 14 bp, synthetic construct
  source 1..14: mol_type = other DNA
cctggatggcgcaa

SEQ ID NO: 4853 - DNA, 14 bp, synthetic construct
  source 1..14: mol_type = other DNA
caaatgaccataac

SEQ ID NO: 4854 - DNA, 14 bp, synthetic construct
  source 1..14: mol_type = other DNA
tgctcaagcgggaa

SEQ ID NO: 4855 - DNA, 14 bp, synthetic construct
  source 1..14: mol_type = other DNA
gaaacggtaaaggt

SEQ ID NO: 4856 - DNA, 14 bp, synthetic construct
  source 1..14: mol_type = other DNA
gcatcagagccata

SEQ ID NO: 4857 - DNA, 14 bp, synthetic construct
  source 1..14: mol_type = other DNA
aaacgcgtgcccct

SEQ ID NO: 4858 - DNA, 14 bp, synthetic construct
  source 1..14: mol_type = other DNA
cggcacattaccaa

SEQ ID NO: 4859 - DNA, 14 bp, synthetic construct
  source 1..14: mol_type = other DNA
atcgcgaatccgcc

SEQ ID NO: 4860 - DNA, 14 bp, synthetic construct
  source 1..14: mol_type = other DNA
ggcgagtcccctag

SEQ ID NO: 4861 - DNA, 14 bp, synthetic construct
  source 1..14: mol_type = other DNA
gaatcgcataacaa

SEQ ID NO: 4862 - DNA, 14 bp, synthetic construct
  source 1..14: mol_type = other DNA
aagctataaccgag

SEQ ID NO: 4863 - DNA, 14 bp, synthetic construct
  source 1..14: mol_type = other DNA
actcaaggatacaa

SEQ ID NO: 4864 - DNA, 14 bp, synthetic construct
  source 1..14: mol_type = other DNA
tcaccatcgggacc

SEQ ID NO: 4865 - DNA, 14 bp, synthetic construct
  source 1..14: mol_type = other DNA
tcctgacgccggag

SEQ ID NO: 4866 - DNA, 14 bp, synthetic construct
  source 1..14: mol_type = other DNA
cccacctggctaac

SEQ ID NO: 4867 - DNA, 14 bp, synthetic construct
  source 1..14: mol_type = other DNA
cctacccacaaact

SEQ ID NO: 4868 - DNA, 14 bp, synthetic construct
  source 1..14: mol_type = other DNA
atagcgaagcataa

SEQ ID NO: 4869 - DNA, 14 bp, synthetic construct
  source 1..14: mol_type = other DNA
agatccccatgcaa

SEQ ID NO: 4870 - DNA, 14 bp, synthetic construct
  source 1..14: mol_type = other DNA
tggaaccgaagata

SEQ ID NO: 4871 - DNA, 14 bp, synthetic construct
  source 1..14: mol_type = other DNA
agataggtaaaagc

SEQ ID NO: 4872 - DNA, 14 bp, synthetic construct
  source 1..14: mol_type = other DNA
cccacatcgccact

SEQ ID NO: 4873 - DNA, 14 bp, synthetic construct
  source 1..14: mol_type = other DNA
ctaccctaccgcgg

SEQ ID NO: 4874 - DNA, 14 bp, synthetic construct
  source 1..14: mol_type = other DNA
cggaaaacggtata

SEQ ID NO: 4875 - DNA, 14 bp, synthetic construct
  source 1..14: mol_type = other DNA
agagcggtggtcca

SEQ ID NO: 4876 - DNA, 14 bp, synthetic construct
  source 1..14: mol_type = other DNA
ggacctagcatggg

SEQ ID NO: 4877 - DNA, 14 bp, synthetic construct
  source 1..14: mol_type = other DNA
cgataggaaacatg

SEQ ID NO: 4878 - DNA, 14 bp, synthetic construct
  source 1..14: mol_type = other DNA
cgtcacacgtggga

SEQ ID NO: 4879 - DNA, 14 bp, synthetic construct
  source 1..14: mol_type = other DNA
acacgagccgaatt

SEQ ID NO: 4880 - DNA, 14 bp, synthetic construct
  source 1..14: mol_type = other DNA
tacatcaggagacg

SEQ ID NO: 4881 - DNA, 14 bp, synthetic construct
  source 1..14: mol_type = other DNA
cggaaccgacgtct

SEQ ID NO: 4882 - DNA, 14 bp, synthetic construct
  source 1..14: mol_type = other DNA
gcaggacttcggac

SEQ ID NO: 4883 - DNA, 14 bp, synthetic construct
  source 1..14: mol_type = other DNA
tagataaggaaaga

SEQ ID NO: 4884 - DNA, 14 bp, synthetic construct
  source 1..14: mol_type = other DNA
catcgacaaacgat

SEQ ID NO: 4885 - DNA, 14 bp, synthetic construct
  source 1..14: mol_type = other DNA
ctcgtacggcggcc

SEQ ID NO: 4886 - DNA, 14 bp, synthetic construct
  source 1..14: mol_type = other DNA
aaaagtcagcctca

SEQ ID NO: 4887 - DNA, 14 bp, synthetic construct
  source 1..14: mol_type = other DNA
atccaataggaata

SEQ ID NO: 4888 - DNA, 14 bp, synthetic construct
  source 1..14: mol_type = other DNA
gaggtgtagtaaca

SEQ ID NO: 4889 - DNA, 14 bp, synthetic construct
  source 1..14: mol_type = other DNA
cgctaaatctgaag

SEQ ID NO: 4890 - DNA, 14 bp, synthetic construct
  source 1..14: mol_type = other DNA
ctaagccgctgaat

SEQ ID NO: 4891 - DNA, 14 bp, synthetic construct
  source 1..14: mol_type = other DNA
tctcgtaaagcgga

SEQ ID NO: 4892 - DNA, 14 bp, synthetic construct
  source 1..14: mol_type = other DNA
acgtcatgagaatc

SEQ ID NO: 4893 - DNA, 14 bp, synthetic construct
  source 1..14: mol_type = other DNA
gattagaaccatga

SEQ ID NO: 4894 - DNA, 14 bp, synthetic construct
  source 1..14: mol_type = other DNA
tgagtgaagagtag

SEQ ID NO: 4895 - DNA, 14 bp, synthetic construct
  source 1..14: mol_type = other DNA
cgcattcaaaaagt

SEQ ID NO: 4896 - DNA, 14 bp, synthetic construct
  source 1..14: mol_type = other DNA
tcagaatacctcgc

SEQ ID NO: 4897 - DNA, 14 bp, synthetic construct
  source 1..14: mol_type = other DNA
ccaggtaagcatct

SEQ ID NO: 4898 - DNA, 14 bp, synthetic construct
  source 1..14: mol_type = other DNA
gtgcgggtagacgt

SEQ ID NO: 4899 - DNA, 14 bp, synthetic construct
  source 1..14: mol_type = other DNA
tgaacgcatgctag

SEQ ID NO: 4900 - DNA, 14 bp, synthetic construct
  source 1..14: mol_type = other DNA
cctgttaggcgaca

SEQ ID NO: 4901 - DNA, 14 bp, synthetic construct
  source 1..14: mol_type = other DNA
agacgctatgaaat

SEQ ID NO: 4902 - DNA, 14 bp, synthetic construct
  source 1..14: mol_type = other DNA
gcctgacaatcggt

SEQ ID NO: 4903 - DNA, 14 bp, synthetic construct
  source 1..14: mol_type = other DNA
cgtaagcaagatta

SEQ ID NO: 4904 - DNA, 14 bp, synthetic construct
  source 1..14: mol_type = other DNA
aagatgtccaatac

SEQ ID NO: 4905 - DNA, 14 bp, synthetic construct
  source 1..14: mol_type = other DNA
ccgtagctaaaaat

SEQ ID NO: 4906 - DNA, 14 bp, synthetic construct
  source 1..14: mol_type = other DNA
acccctgcaatact

SEQ ID NO: 4907 - DNA, 14 bp, synthetic construct
  source 1..14: mol_type = other DNA
agccaacccctatt

SEQ ID NO: 4908 - DNA, 14 bp, synthetic construct
  source 1..14: mol_type = other DNA
gatgcttagggacc

SEQ ID NO: 4909 - DNA, 14 bp, synthetic construct
  source 1..14: mol_type = other DNA
taccagtagaagta

SEQ ID NO: 4910 - DNA, 14 bp, synthetic construct
  source 1..14: mol_type = other DNA
ggcagccgttatag

SEQ ID NO: 4911 - DNA, 14 bp, synthetic construct
  source 1..14: mol_type = other DNA
gctcggcttgcggg

SEQ ID NO: 4912 - DNA, 14 bp, synthetic construct
  source 1..14: mol_type = other DNA
cgagcctcctgctg

SEQ ID NO: 4913 - DNA, 14 bp, synthetic construct
  source 1..14: mol_type = other DNA
ttgcccactgagac

SEQ ID NO: 4914 - DNA, 14 bp, synthetic construct
  source 1..14: mol_type = other DNA
ggcctaatgaccct

SEQ ID NO: 4915 - DNA, 14 bp, synthetic construct
  source 1..14: mol_type = other DNA
gtagtatcggaaac

SEQ ID NO: 4916 - DNA, 14 bp, synthetic construct
  source 1..14: mol_type = other DNA
agttacgcagtcca

SEQ ID NO: 4917 - DNA, 14 bp, synthetic construct
  source 1..14: mol_type = other DNA
catcaagatagggt

SEQ ID NO: 4918 - DNA, 14 bp, synthetic construct
  source 1..14: mol_type = other DNA
atcctaaccataaa

SEQ ID NO: 4919 - DNA, 14 bp, synthetic construct
  source 1..14: mol_type = other DNA
ggcataatactcac

SEQ ID NO: 4920 - DNA, 14 bp, synthetic construct
  source 1..14: mol_type = other DNA
tgggcctatcgggc

SEQ ID NO: 4921 - DNA, 14 bp, synthetic construct
  source 1..14: mol_type = other DNA
taagatgaagcatg

SEQ ID NO: 4922 - DNA, 14 bp, synthetic construct
  source 1..14: mol_type = other DNA
cgtcaaccattgaa

SEQ ID NO: 4923 - DNA, 14 bp, synthetic construct
  source 1..14: mol_type = other DNA
acagcatcgagatt

SEQ ID NO: 4924 - DNA, 14 bp, synthetic construct
  source 1..14: mol_type = other DNA
ggttagctgaagaa

SEQ ID NO: 4925 - DNA, 14 bp, synthetic construct
  source 1..14: mol_type = other DNA
tagtcccagtaaga

SEQ ID NO: 4926 - DNA, 14 bp, synthetic construct
  source 1..14: mol_type = other DNA
acgggtgccaattg

SEQ ID NO: 4927 - DNA, 14 bp, synthetic construct
  source 1..14: mol_type = other DNA
ggcacatcgttcag

SEQ ID NO: 4928 - DNA, 14 bp, synthetic construct
  source 1..14: mol_type = other DNA
agcaacctactata

SEQ ID NO: 4929 - DNA, 14 bp, synthetic construct
  source 1..14: mol_type = other DNA
gagcccatctgtgg

SEQ ID NO: 4930 - DNA, 14 bp, synthetic construct
  source 1..14: mol_type = other DNA
gacagtgtagctac

SEQ ID NO: 4931 - DNA, 14 bp, synthetic construct
  source 1..14: mol_type = other DNA
catactggctgcgg

SEQ ID NO: 4932 - DNA, 14 bp, synthetic construct
  source 1..14: mol_type = other DNA
gtcggctgaggaat

SEQ ID NO: 4933 - DNA, 14 bp, synthetic construct
  source 1..14: mol_type = other DNA
aatgcgatctgagc

SEQ ID NO: 4934 - DNA, 14 bp, synthetic construct
  source 1..14: mol_type = other DNA
gtcgcagacaagtt

SEQ ID NO: 4935 - DNA, 14 bp, synthetic construct
  source 1..14: mol_type = other DNA
attggccccccgct

SEQ ID NO: 4936 - DNA, 14 bp, synthetic construct
  source 1..14: mol_type = other DNA
gcgtagttaacgcg

SEQ ID NO: 4937 - DNA, 14 bp, synthetic construct
  source 1..14: mol_type = other DNA
gggtgctaggataa

SEQ ID NO: 4938 - DNA, 14 bp, synthetic construct
  source 1..14: mol_type = other DNA
aacactacttaacg

SEQ ID NO: 4939 - DNA, 14 bp, synthetic construct
  source 1..14: mol_type = other DNA
tcccacacctcagt

SEQ ID NO: 4940 - DNA, 14 bp, synthetic construct
  source 1..14: mol_type = other DNA
ttcatcgaacaaaa

SEQ ID NO: 4941 - DNA, 14 bp, synthetic construct
  source 1..14: mol_type = other DNA
tctagcagcggctc

SEQ ID NO: 4942 - DNA, 14 bp, synthetic construct
  source 1..14: mol_type = other DNA
cctgcccgtcatcc

SEQ ID NO: 4943 - DNA, 14 bp, synthetic construct
  source 1..14: mol_type = other DNA
gagttgccatcaag

SEQ ID NO: 4944 - DNA, 14 bp, synthetic construct
  source 1..14: mol_type = other DNA
tcagcccctagatg

SEQ ID NO: 4945 - DNA, 14 bp, synthetic construct
  source 1..14: mol_type = other DNA
gtgtgcggtacaac

SEQ ID NO: 4946 - DNA, 14 bp, synthetic construct
  source 1..14: mol_type = other DNA
ggagtgtgacatca

SEQ ID NO: 4947 - DNA, 14 bp, synthetic construct
  source 1..14: mol_type = other DNA
attgcggcaatgca

SEQ ID NO: 4948 - DNA, 14 bp, synthetic construct
  source 1..14: mol_type = other DNA
cccaggtttgagca

SEQ ID NO: 4949 - DNA, 14 bp, synthetic construct
  source 1..14: mol_type = other DNA
ctccgacgataagt

SEQ ID NO: 4950 - DNA, 14 bp, synthetic construct
  source 1..14: mol_type = other DNA
gatagcagtctcaa

SEQ ID NO: 4951 - DNA, 14 bp, synthetic construct
  source 1..14: mol_type = other DNA
cgcctcccgtgtac

SEQ ID NO: 4952 - DNA, 14 bp, synthetic construct
  source 1..14: mol_type = other DNA
cagctacagacatt

SEQ ID NO: 4953 - DNA, 14 bp, synthetic construct
  source 1..14: mol_type = other DNA
tgatctcgcgcccg

SEQ ID NO: 4954 - DNA, 14 bp, synthetic construct
  source 1..14: mol_type = other DNA
cagcctggtcataa

SEQ ID NO: 4955 - DNA, 14 bp, synthetic construct
  source 1..14: mol_type = other DNA
tccgatcgccgcgt

SEQ ID NO: 4956 - DNA, 14 bp, synthetic construct
  source 1..14: mol_type = other DNA
gctagcgggtgcct

SEQ ID NO: 4957 - DNA, 14 bp, synthetic construct
  source 1..14: mol_type = other DNA
tcaaaacgttaagg

SEQ ID NO: 4958 - DNA, 14 bp, synthetic construct
  source 1..14: mol_type = other DNA
gctggcagaatcta

SEQ ID NO: 4959 - DNA, 14 bp, synthetic construct
  source 1..14: mol_type = other DNA
tcctggcgtccgca

SEQ ID NO: 4960 - DNA, 14 bp, synthetic construct
  source 1..14: mol_type = other DNA
gtataacccaacct

SEQ ID NO: 4961 - DNA, 14 bp, synthetic construct
  source 1..14: mol_type = other DNA
gaagtaccggtatg

SEQ ID NO: 4962 - DNA, 14 bp, synthetic construct
  source 1..14: mol_type = other DNA
caagctactgcata

SEQ ID NO: 4963 - DNA, 14 bp, synthetic construct
  source 1..14: mol_type = other DNA
aggcggtctgcctg

SEQ ID NO: 4964 - DNA, 14 bp, synthetic construct
  source 1..14: mol_type = other DNA
acacggacggttat

SEQ ID NO: 4965 - DNA, 14 bp, synthetic construct
  source 1..14: mol_type = other DNA
ccagttagccgctc

SEQ ID NO: 4966 - DNA, 14 bp, synthetic construct
  source 1..14: mol_type = other DNA
taaaaatagaccct

SEQ ID NO: 4967 - DNA, 14 bp, synthetic construct
  source 1..14: mol_type = other DNA
tcgtcagactacaa

SEQ ID NO: 4968 - DNA, 14 bp, synthetic construct
  source 1..14: mol_type = other DNA
acatcggctcgtgg

SEQ ID NO: 4969 - DNA, 14 bp, synthetic construct
  source 1..14: mol_type = other DNA
acgccgtttgaagc

SEQ ID NO: 4970 - DNA, 14 bp, synthetic construct
  source 1..14: mol_type = other DNA
ctctgaggagctca

SEQ ID NO: 4971 - DNA, 14 bp, synthetic construct
  source 1..14: mol_type = other DNA
gtcggcgtcgtaga

SEQ ID NO: 4972 - DNA, 14 bp, synthetic construct
  source 1..14: mol_type = other DNA
tagcattcccagac

SEQ ID NO: 4973 - DNA, 14 bp, synthetic construct
  source 1..14: mol_type = other DNA
gtagttcccggccg

SEQ ID NO: 4974 - DNA, 14 bp, synthetic construct
  source 1..14: mol_type = other DNA
tgctgcacccaata

SEQ ID NO: 4975 - DNA, 14 bp, synthetic construct
  source 1..14: mol_type = other DNA
caaccccttgactc

SEQ ID NO: 4976 - DNA, 14 bp, synthetic construct
  source 1..14: mol_type = other DNA
aggtgtggactcac

SEQ ID NO: 4977 - DNA, 14 bp, synthetic construct
  source 1..14: mol_type = other DNA
acgcctcataagct

SEQ ID NO: 4978 - DNA, 14 bp, synthetic construct
  source 1..14: mol_type = other DNA
gagatcgatccgat

SEQ ID NO: 4979 - DNA, 14 bp, synthetic construct
  source 1..14: mol_type = other DNA
cggctagcgggtgt

SEQ ID NO: 4980 - DNA, 14 bp, synthetic construct
  source 1..14: mol_type = other DNA
aggccctacttcga

SEQ ID NO: 4981 - DNA, 14 bp, synthetic construct
  source 1..14: mol_type = other DNA
gtgcataacacagt

SEQ ID NO: 4982 - DNA, 14 bp, synthetic construct
  source 1..14: mol_type = other DNA
ttacgatgacgggc

SEQ ID NO: 4983 - DNA, 14 bp, synthetic construct
  source 1..14: mol_type = other DNA
ttaggactcccgga

SEQ ID NO: 4984 - DNA, 14 bp, synthetic construct
  source 1..14: mol_type = other DNA
aacacatgacgtat

SEQ ID NO: 4985 - DNA, 14 bp, synthetic construct
  source 1..14: mol_type = other DNA
gcctgatcgatgcc

SEQ ID NO: 4986 - DNA, 14 bp, synthetic construct
  source 1..14: mol_type = other DNA
agcctggatcgatg

SEQ ID NO: 4987 - DNA, 14 bp, synthetic construct
  source 1..14: mol_type = other DNA
ccgttcagccaagt

SEQ ID NO: 4988 - DNA, 14 bp, synthetic construct
  source 1..14: mol_type = other DNA
ccaatggtcacatc

SEQ ID NO: 4989 - DNA, 14 bp, synthetic construct
  source 1..14: mol_type = other DNA
gtggagccattcgg

SEQ ID NO: 4990 - DNA, 14 bp, synthetic construct
  source 1..14: mol_type = other DNA
tgccaggggagctt

SEQ ID NO: 4991 - DNA, 14 bp, synthetic construct
  source 1..14: mol_type = other DNA
gatccgcaaattag

SEQ ID NO: 4992 - DNA, 14 bp, synthetic construct
  source 1..14: mol_type = other DNA
gtctacacacatga

SEQ ID NO: 4993 - DNA, 14 bp, synthetic construct
  source 1..14: mol_type = other DNA
gggcatataatggc

SEQ ID NO: 4994 - DNA, 14 bp, synthetic construct
  source 1..14: mol_type = other DNA
atccgtaacgatag

SEQ ID NO: 4995 - DNA, 14 bp, synthetic construct
  source 1..14: mol_type = other DNA
acacatttacccgg

SEQ ID NO: 4996 - DNA, 14 bp, synthetic construct
  source 1..14: mol_type = other DNA
gtcctgtcccaaac

SEQ ID NO: 4997 - DNA, 14 bp, synthetic construct
  source 1..14: mol_type = other DNA
gagcctgatgcgtc

SEQ ID NO: 4998 - DNA, 14 bp, synthetic construct
  source 1..14: mol_type = other DNA
aatgttcgcagggc

SEQ ID NO: 4999 - DNA, 14 bp, synthetic construct
  source 1..14: mol_type = other DNA
tcgcttccgggaaa

SEQ ID NO: 5000 - DNA, 14 bp, synthetic construct
  source 1..14: mol_type = other DNA
gttagggaggcggt

SEQ ID NO: 5001 - DNA, 14 bp, synthetic construct
  source 1..14: mol_type = other DNA
aggtgctcgatggc

SEQ ID NO: 5002 - DNA, 14 bp, synthetic construct
  source 1..14: mol_type = other DNA
cggctatcactaca

SEQ ID NO: 5003 - DNA, 14 bp, synthetic construct
  source 1..14: mol_type = other DNA
cgctcgagcgtatc

SEQ ID NO: 5004 - DNA, 14 bp, synthetic construct
  source 1..14: mol_type = other DNA
acctcacatacatc

SEQ ID NO: 5005 - DNA, 14 bp, synthetic construct
  source 1..14: mol_type = other DNA
gggaccgtccgtta

SEQ ID NO: 5006 - DNA, 14 bp, synthetic construct
  source 1..14: mol_type = other DNA
gggtgcgcctcagt

SEQ ID NO: 5007 - DNA, 14 bp, synthetic construct
  source 1..14: mol_type = other DNA
gggtccaatcctag

SEQ ID NO: 5008 - DNA, 14 bp, synthetic construct
  source 1..14: mol_type = other DNA
gtgatcgtacggga

SEQ ID NO: 5009 - DNA, 14 bp, synthetic construct
  source 1..14: mol_type = other DNA
caagcaggtatcct

SEQ ID NO: 5010 - DNA, 14 bp, synthetic construct
  source 1..14: mol_type = other DNA
tcccctccctaagc

SEQ ID NO: 5011 - DNA, 14 bp, synthetic construct
  source 1..14: mol_type = other DNA
tccagagacttgcg

SEQ ID NO: 5012 - DNA, 14 bp, synthetic construct
  source 1..14: mol_type = other DNA
tcggtggatgccaa

SEQ ID NO: 5013 - DNA, 14 bp, synthetic construct
  source 1..14: mol_type = other DNA
gctagctcggtaac

SEQ ID NO: 5014 - DNA, 14 bp, synthetic construct
  source 1..14: mol_type = other DNA
cagaggcttgactg

SEQ ID NO: 5015 - DNA, 14 bp, synthetic construct
  source 1..14: mol_type = other DNA
aaggtggccttacg

SEQ ID NO: 5016 - DNA, 14 bp, synthetic construct
  source 1..14: mol_type = other DNA
tcaggtacctgcgg

SEQ ID NO: 5017 - DNA, 14 bp, synthetic construct
  source 1..14: mol_type = other DNA
aatactaagtgaga

SEQ ID NO: 5018 - DNA, 14 bp, synthetic construct
  source 1..14: mol_type = other DNA
taggagtagccact

SEQ ID NO: 5019 - DNA, 14 bp, synthetic construct
  source 1..14: mol_type = other DNA
gatccctggaacat

SEQ ID NO: 5020 - DNA, 14 bp, synthetic construct
  source 1..14: mol_type = other DNA
atgctatgcccaca

SEQ ID NO: 5021 - DNA, 14 bp, synthetic construct
  source 1..14: mol_type = other DNA
caacagcgattgct

SEQ ID NO: 5022 - DNA, 14 bp, synthetic construct
  source 1..14: mol_type = other DNA
gcagttaggatcaa

SEQ ID NO: 5023 - DNA, 14 bp, synthetic construct
  source 1..14: mol_type = other DNA
gtcatggccctgcc

SEQ ID NO: 5024 - DNA, 14 bp, synthetic construct
  source 1..14: mol_type = other DNA
tagaatgggtcaac

SEQ ID NO: 5025 - DNA, 14 bp, synthetic construct
  source 1..14: mol_type = other DNA
gggcgattcggtac

SEQ ID NO: 5026 - DNA, 14 bp, synthetic construct
  source 1..14: mol_type = other DNA
cagactactagctc

SEQ ID NO: 5027 - DNA, 14 bp, synthetic construct
  source 1..14: mol_type = other DNA
ccgtcaatagtccg

SEQ ID NO: 5028 - DNA, 14 bp, synthetic construct
  source 1..14: mol_type = other DNA
gccaagccgtaatt

SEQ ID NO: 5029 - DNA, 14 bp, synthetic construct
  source 1..14: mol_type = other DNA
acaccaattaccat

SEQ ID NO: 5030 - DNA, 14 bp, synthetic construct
  source 1..14: mol_type = other DNA
gcctcggtccataa

SEQ ID NO: 5031 - DNA, 14 bp, synthetic construct
  source 1..14: mol_type = other DNA
aggaacccatcatt

SEQ ID NO: 5032 - DNA, 14 bp, synthetic construct
  source 1..14: mol_type = other DNA
ggcgtcccgattag

SEQ ID NO: 5033 - DNA, 14 bp, synthetic construct
  source 1..14: mol_type = other DNA
ttcaatcacacgag

SEQ ID NO: 5034 - DNA, 14 bp, synthetic construct
  source 1..14: mol_type = other DNA
caccccttacctag

SEQ ID NO: 5035 - DNA, 14 bp, synthetic construct
  source 1..14: mol_type = other DNA
tacggtccactgag

SEQ ID NO: 5036 - DNA, 14 bp, synthetic construct
  source 1..14: mol_type = other DNA
agccgacactactt

SEQ ID NO: 5037 - DNA, 14 bp, synthetic construct
  source 1..14: mol_type = other DNA
cggctaagtgtacg

SEQ ID NO: 5038 - DNA, 14 bp, synthetic construct
  source 1..14: mol_type = other DNA
gatgtgcgctcgcg

SEQ ID NO: 5039 - DNA, 14 bp, synthetic construct
  source 1..14: mol_type = other DNA
gacctcttaaacaa

SEQ ID NO: 5040 - DNA, 14 bp, synthetic construct
  source 1..14: mol_type = other DNA
gccctatacgtgca

SEQ ID NO: 5041 - DNA, 14 bp, synthetic construct
  source 1..14: mol_type = other DNA
gcccttataaggag

SEQ ID NO: 5042 - DNA, 14 bp, synthetic construct
  source 1..14: mol_type = other DNA
cctcaaaatgtgac

SEQ ID NO: 5043 - DNA, 14 bp, synthetic construct
  source 1..14: mol_type = other DNA
gagaattcctgggg

SEQ ID NO: 5044 - DNA, 14 bp, synthetic construct
  source 1..14: mol_type = other DNA
gccattactgggcg

SEQ ID NO: 5045 - DNA, 14 bp, synthetic construct
  source 1..14: mol_type = other DNA
ggtccctaggcgct

SEQ ID NO: 5046 - DNA, 14 bp, synthetic construct
  source 1..14: mol_type = other DNA
aatgactatcgccg

SEQ ID NO: 5047 - DNA, 14 bp, synthetic construct
  source 1..14: mol_type = other DNA
agtaccgggttagc

SEQ ID NO: 5048 - DNA, 14 bp, synthetic construct
  source 1..14: mol_type = other DNA
ccgtccagattaaa

SEQ ID NO: 5049 - DNA, 14 bp, synthetic construct
  source 1..14: mol_type = other DNA
tgcgccatctagaa

SEQ ID NO: 5050 - DNA, 14 bp, synthetic construct
  source 1..14: mol_type = other DNA
tccagcgctggaat

SEQ ID NO: 5051 - DNA, 14 bp, synthetic construct
  source 1..14: mol_type = other DNA
cgtgacgtaggcgt

SEQ ID NO: 5052 - DNA, 14 bp, synthetic construct
  source 1..14: mol_type = other DNA
gtatatcagccaga

SEQ ID NO: 5053 - DNA, 14 bp, synthetic construct
  source 1..14: mol_type = other DNA
ggtaggcagtgact

SEQ ID NO: 5054 - DNA, 14 bp, synthetic construct
  source 1..14: mol_type = other DNA
gtccttaagccgcc

SEQ ID NO: 5055 - DNA, 14 bp, synthetic construct
  source 1..14: mol_type = other DNA
catgggcgatgctg

SEQ ID NO: 5056 - DNA, 14 bp, synthetic construct
  source 1..14: mol_type = other DNA
ggtccaaatgcatg

SEQ ID NO: 5057 - DNA, 14 bp, synthetic construct
  source 1..14: mol_type = other DNA
taacgaccttcgaa

SEQ ID NO: 5058 - DNA, 14 bp, synthetic construct
  source 1..14: mol_type = other DNA
tcggtaagctacgc

SEQ ID NO: 5059 - DNA, 14 bp, synthetic construct
  source 1..14: mol_type = other DNA
ggaattccatcggc

SEQ ID NO: 5060 - DNA, 14 bp, synthetic construct
  source 1..14: mol_type = other DNA
atcagtgtggagga

SEQ ID NO: 5061 - DNA, 14 bp, synthetic construct
  source 1..14: mol_type = other DNA
ggcggtgccattac

SEQ ID NO: 5062 - DNA, 14 bp, synthetic construct
  source 1..14: mol_type = other DNA
gccttcaaactaga

SEQ ID NO: 5063 - DNA, 14 bp, synthetic construct
  source 1..14: mol_type = other DNA
ccttgcgtgcaggc

SEQ ID NO: 5064 - DNA, 14 bp, synthetic construct
  source 1..14: mol_type = other DNA
cgttactggccacg

SEQ ID NO: 5065 - DNA, 14 bp, synthetic construct
  source 1..14: mol_type = other DNA
gtgtacaagtagcc

SEQ ID NO: 5066 - DNA, 14 bp, synthetic construct
  source 1..14: mol_type = other DNA
ttcggctgggccgg

SEQ ID NO: 5067 - DNA, 14 bp, synthetic construct
  source 1..14: mol_type = other DNA
acgcgagtcatctg

SEQ ID NO: 5068 - DNA, 14 bp, synthetic construct
  source 1..14: mol_type = other DNA
gtacacgtggctag

SEQ ID NO: 5069 - DNA, 14 bp, synthetic construct
  source 1..14: mol_type = other DNA
taccctgatgagaa

SEQ ID NO: 5070 - DNA, 14 bp, synthetic construct
  source 1..14: mol_type = other DNA
cctggcctggagta

SEQ ID NO: 5071 - DNA, 14 bp, synthetic construct
  source 1..14: mol_type = other DNA
agcgaggatcactt

SEQ ID NO: 5072 - DNA, 14 bp, synthetic construct
  source 1..14: mol_type = other DNA
tctgccgtcggcac

SEQ ID NO: 5073 - DNA, 14 bp, synthetic construct
  source 1..14: mol_type = other DNA
ctagagataataaa

SEQ ID NO: 5074 - DNA, 14 bp, synthetic construct
  source 1..14: mol_type = other DNA
ccgtgcgatgtgcc

SEQ ID NO: 5075 - DNA, 14 bp, synthetic construct
  source 1..14: mol_type = other DNA
agatcgccattacg

SEQ ID NO: 5076 - DNA, 14 bp, synthetic construct
  source 1..14: mol_type = other DNA
tgtcagcgggtcag

SEQ ID NO: 5077 - DNA, 14 bp, synthetic construct
  source 1..14: mol_type = other DNA
gcttccagcaatac

SEQ ID NO: 5078 - DNA, 14 bp, synthetic construct
  source 1..14: mol_type = other DNA
gcttaagaggctag

SEQ ID NO: 5079 - DNA, 14 bp, synthetic construct
  source 1..14: mol_type = other DNA
ctttgcgccgcgga

SEQ ID NO: 5080 - DNA, 14 bp, synthetic construct
  source 1..14: mol_type = other DNA
tagaagtgacacta

SEQ ID NO: 5081 - DNA, 14 bp, synthetic construct
  source 1..14: mol_type = other DNA
tcgagtacggtggc

SEQ ID NO: 5082 - DNA, 14 bp, synthetic construct
  source 1..14: mol_type = other DNA
ggtacatccgctag

SEQ ID NO: 5083 - DNA, 14 bp, synthetic construct
  source 1..14: mol_type = other DNA
gcgctaaagtccgt

SEQ ID NO: 5084 - DNA, 14 bp, synthetic construct
  source 1..14: mol_type = other DNA
cgtctccatcggag

SEQ ID NO: 5085 - DNA, 14 bp, synthetic construct
  source 1..14: mol_type = other DNA
ccctaccaatgagt

SEQ ID NO: 5086 - DNA, 14 bp, synthetic construct
  source 1..14: mol_type = other DNA
ccaccgctctgcat

SEQ ID NO: 5087 - DNA, 14 bp, synthetic construct
  source 1..14: mol_type = other DNA
cctcaccaggctct

SEQ ID NO: 5088 - DNA, 14 bp, synthetic construct
  source 1..14: mol_type = other DNA
gtattcacgaaaca

SEQ ID NO: 5089 - DNA, 14 bp, synthetic construct
  source 1..14: mol_type = other DNA
ttgctaaagagccc

SEQ ID NO: 5090 - DNA, 14 bp, synthetic construct
  source 1..14: mol_type = other DNA
gcgaccgtactgat

SEQ ID NO: 5091 - DNA, 14 bp, synthetic construct
  source 1..14: mol_type = other DNA
cgctcgctaggata

SEQ ID NO: 5092 - DNA, 14 bp, synthetic construct
  source 1..14: mol_type = other DNA
gaccatgttgcaag

SEQ ID NO: 5093 - DNA, 14 bp, synthetic construct
  source 1..14: mol_type = other DNA
ccgtctgcgccagt

SEQ ID NO: 5094 - DNA, 14 bp, synthetic construct
  source 1..14: mol_type = other DNA
catcccgattacac

SEQ ID NO: 5095 - DNA, 14 bp, synthetic construct
  source 1..14: mol_type = other DNA
gatgaaagaggtgt

SEQ ID NO: 5096 - DNA, 14 bp, synthetic construct
  source 1..14: mol_type = other DNA
ggtactaatcccga

SEQ ID NO: 5097 - DNA, 14 bp, synthetic construct
  source 1..14: mol_type = other DNA
aacgttcctaagga

SEQ ID NO: 5098 - DNA, 14 bp, synthetic construct
  source 1..14: mol_type = other DNA
aacgggtggagtat

SEQ ID NO: 5099 - DNA, 14 bp, synthetic construct
  source 1..14: mol_type = other DNA
ggagtatgcgctgg

SEQ ID NO: 5100 - DNA, 14 bp, synthetic construct
  source 1..14: mol_type = other DNA
atccttccgaacgg

SEQ ID NO: 5101 - DNA, 14 bp, synthetic construct
  source 1..14: mol_type = other DNA
ccctcgctcacgta

SEQ ID NO: 5102 - DNA, 14 bp, synthetic construct
  source 1..14: mol_type = other DNA
atacttaagggcac

SEQ ID NO: 5103 - DNA, 14 bp, synthetic construct
  source 1..14: mol_type = other DNA
tcgtaccaaatgag

SEQ ID NO: 5104 - DNA, 14 bp, synthetic construct
  source 1..14: mol_type = other DNA
ccccaaaggaattt

SEQ ID NO: 5105 - DNA, 14 bp, synthetic construct
  source 1..14: mol_type = other DNA
gatccgttaaggaa

SEQ ID NO: 5106 - DNA, 14 bp, synthetic construct
  source 1..14: mol_type = other DNA
taggcgaccccgtt

SEQ ID NO: 5107 - DNA, 14 bp, synthetic construct
  source 1..14: mol_type = other DNA
tttacgcacggacg

SEQ ID NO: 5108 - DNA, 14 bp, synthetic construct
  source 1..14: mol_type = other DNA
tggttgcagacaac

SEQ ID NO: 5109 - DNA, 14 bp, synthetic construct
  source 1..14: mol_type = other DNA
aagaggtatcgtaa

SEQ ID NO: 5110 - DNA, 14 bp, synthetic construct
  source 1..14: mol_type = other DNA
acccgtgggaagtt

SEQ ID NO: 5111 - DNA, 14 bp, synthetic construct
  source 1..14: mol_type = other DNA
cacacgcccttgtg

SEQ ID NO: 5112 - DNA, 14 bp, synthetic construct
  source 1..14: mol_type = other DNA
acacaactgggttg

SEQ ID NO: 5113 - DNA, 14 bp, synthetic construct
  source 1..14: mol_type = other DNA
accaaatcaattga

SEQ ID NO: 5114 - DNA, 14 bp, synthetic construct
  source 1..14: mol_type = other DNA
cgtgcctacgagta

SEQ ID NO: 5115 - DNA, 14 bp, synthetic construct
  source 1..14: mol_type = other DNA
taccaccccaaatt

SEQ ID NO: 5116 - DNA, 14 bp, synthetic construct
  source 1..14: mol_type = other DNA
atggtcccagtgac

SEQ ID NO: 5117 - DNA, 14 bp, synthetic construct
  source 1..14: mol_type = other DNA
gaatcctggtccac

SEQ ID NO: 5118 - DNA, 14 bp, synthetic construct
  source 1..14: mol_type = other DNA
tgcaggtcatcgag

SEQ ID NO: 5119 - DNA, 14 bp, synthetic construct
  source 1..14: mol_type = other DNA
tagatatcgccggc

SEQ ID NO: 5120 - DNA, 14 bp, synthetic construct
  source 1..14: mol_type = other DNA
cagccgtcgctaat

SEQ ID NO: 5121 - DNA, 14 bp, synthetic construct
  source 1..14: mol_type = other DNA
ttgcgggagaatgg

SEQ ID NO: 5122 - DNA, 14 bp, synthetic construct
  source 1..14: mol_type = other DNA
acgcgtagtcacgt

SEQ ID NO: 5123 - DNA, 14 bp, synthetic construct
  source 1..14: mol_type = other DNA
cgcgactcactcat

SEQ ID NO: 5124 - DNA, 14 bp, synthetic construct
  source 1..14: mol_type = other DNA
ctacgtaggtgaca

SEQ ID NO: 5125 - DNA, 14 bp, synthetic construct
  source 1..14: mol_type = other DNA
ctcgcatcgcggta

SEQ ID NO: 5126 - DNA, 14 bp, synthetic construct
  source 1..14: mol_type = other DNA
cgcttacacaactc

SEQ ID NO: 5127 - DNA, 14 bp, synthetic construct
  source 1..14: mol_type = other DNA
tagcggaggctact

SEQ ID NO: 5128 - DNA, 14 bp, synthetic construct
  source 1..14: mol_type = other DNA
agattggaccctca

SEQ ID NO: 5129 - DNA, 14 bp, synthetic construct
  source 1..14: mol_type = other DNA
gccataccatactc

SEQ ID NO: 5130 - DNA, 14 bp, synthetic construct
  source 1..14: mol_type = other DNA
gtccggcactatga

SEQ ID NO: 5131 - DNA, 14 bp, synthetic construct
  source 1..14: mol_type = other DNA
ctaaggttcaagga

SEQ ID NO: 5132 - DNA, 14 bp, synthetic construct
  source 1..14: mol_type = other DNA
tacgagacgtcatg

SEQ ID NO: 5133 - DNA, 14 bp, synthetic construct
  source 1..14: mol_type = other DNA
gtatcagtcaaacg

SEQ ID NO: 5134 - DNA, 14 bp, synthetic construct
  source 1..14: mol_type = other DNA
gtagcatgagtaca

SEQ ID NO: 5135 - DNA, 14 bp, synthetic construct
  source 1..14: mol_type = other DNA
ggaacgatctccct

SEQ ID NO: 5136 - DNA, 14 bp, synthetic construct
  source 1..14: mol_type = other DNA
cgcggattcgcggt

SEQ ID NO: 5137 - DNA, 14 bp, synthetic construct
  source 1..14: mol_type = other DNA
cacgtcaaattcac

SEQ ID NO: 5138 - DNA, 14 bp, synthetic construct
  source 1..14: mol_type = other DNA
cacatactcagatc

SEQ ID NO: 5139 - DNA, 14 bp, synthetic construct
  source 1..14: mol_type = other DNA
acccttgaactgac

SEQ ID NO: 5140 - DNA, 14 bp, synthetic construct
  source 1..14: mol_type = other DNA
aaaatgcgcgtggt

SEQ ID NO: 5141 - DNA, 14 bp, synthetic construct
  source 1..14: mol_type = other DNA
gttaagacgtccga

SEQ ID NO: 5142 - DNA, 14 bp, synthetic construct
  source 1..14: mol_type = other DNA
cgatgtcgctacgc

SEQ ID NO: 5143 - DNA, 14 bp, synthetic construct
  source 1..14: mol_type = other DNA
gatgacggaattga

SEQ ID NO: 5144 - DNA, 14 bp, synthetic construct
  source 1..14: mol_type = other DNA
cgctcagttaaccc

SEQ ID NO: 5145 - DNA, 14 bp, synthetic construct
  source 1..14: mol_type = other DNA
gccgctgatgaact

SEQ ID NO: 5146 - DNA, 14 bp, synthetic construct
  source 1..14: mol_type = other DNA
tcataagaccgtcc

SEQ ID NO: 5147 - DNA, 14 bp, synthetic construct
  source 1..14: mol_type = other DNA
gtgacgcagagttc

SEQ ID NO: 5148 - DNA, 14 bp, synthetic construct
  source 1..14: mol_type = other DNA
ggtgagcactccgt

SEQ ID NO: 5149 - DNA, 14 bp, synthetic construct
  source 1..14: mol_type = other DNA
aataaggtactcag

SEQ ID NO: 5150 - DNA, 14 bp, synthetic construct
  source 1..14: mol_type = other DNA
gtgatgtagcgcaa

SEQ ID NO: 5151 - DNA, 14 bp, synthetic construct
  source 1..14: mol_type = other DNA
gctggcttcaagga

SEQ ID NO: 5152 - DNA, 14 bp, synthetic construct
  source 1..14: mol_type = other DNA
caaataagtcaggt

SEQ ID NO: 5153 - DNA, 14 bp, synthetic construct
  source 1..14: mol_type = other DNA
aaaggggaccttct

SEQ ID NO: 5154 - DNA, 14 bp, synthetic construct
  source 1..14: mol_type = other DNA
cgaccttaggtacc

SEQ ID NO: 5155 - DNA, 14 bp, synthetic construct
  source 1..14: mol_type = other DNA
cccggtagcgattg

SEQ ID NO: 5156 - DNA, 14 bp, synthetic construct
  source 1..14: mol_type = other DNA
gtgactgggcggat

SEQ ID NO: 5157 - DNA, 14 bp, synthetic construct
  source 1..14: mol_type = other DNA
ctccgcatacgcat

SEQ ID NO: 5158 - DNA, 14 bp, synthetic construct
  source 1..14: mol_type = other DNA
aaggctaaatctaa

SEQ ID NO: 5159 - DNA, 14 bp, synthetic construct
  source 1..14: mol_type = other DNA
ctcagctcgctaga

SEQ ID NO: 5160 - DNA, 14 bp, synthetic construct
  source 1..14: mol_type = other DNA
ctgtgctaccgaaa

SEQ ID NO: 5161 - DNA, 14 bp, synthetic construct
  source 1..14: mol_type = other DNA
caccagtatcgtag

SEQ ID NO: 5162 - DNA, 14 bp, synthetic construct
  source 1..14: mol_type = other DNA
ttggcaggtacggg

SEQ ID NO: 5163 - DNA, 14 bp, synthetic construct
  source 1..14: mol_type = other DNA
tatacataccgggg

SEQ ID NO: 5164 - DNA, 14 bp, synthetic construct
  source 1..14: mol_type = other DNA
gagatggtgggagt

SEQ ID NO: 5165 - DNA, 14 bp, synthetic construct
  source 1..14: mol_type = other DNA
tccttcaggaaaac

SEQ ID NO: 5166 - DNA, 14 bp, synthetic construct
  source 1..14: mol_type = other DNA
cagacgtcgttgga

SEQ ID NO: 5167 - DNA, 14 bp, synthetic construct
  source 1..14: mol_type = other DNA
gatactatgacgac

SEQ ID NO: 5168 - DNA, 14 bp, synthetic construct
  source 1..14: mol_type = other DNA
cgctgctctccgag

SEQ ID NO: 5169 - DNA, 14 bp, synthetic construct
  source 1..14: mol_type = other DNA
caatggaaagaatt

SEQ ID NO: 5170 - DNA, 14 bp, synthetic construct
  source 1..14: mol_type = other DNA
acatgaaatctcag

SEQ ID NO: 5171 - DNA, 14 bp, synthetic construct
  source 1..14: mol_type = other DNA
tccctgcccacgct

SEQ ID NO: 5172 - DNA, 14 bp, synthetic construct
  source 1..14: mol_type = other DNA
cggatacctactgg

SEQ ID NO: 5173 - DNA, 14 bp, synthetic construct
  source 1..14: mol_type = other DNA
gcactaggtatcgc

SEQ ID NO: 5174 - DNA, 14 bp, synthetic construct
  source 1..14: mol_type = other DNA
cacagatactaata

SEQ ID NO: 5175 - DNA, 14 bp, synthetic construct
  source 1..14: mol_type = other DNA
attcctcagcaggc

SEQ ID NO: 5176 - DNA, 14 bp, synthetic construct
  source 1..14: mol_type = other DNA
tattcggcgagaac

SEQ ID NO: 5177 - DNA, 14 bp, synthetic construct
  source 1..14: mol_type = other DNA
tcaccacgcaattg

SEQ ID NO: 5178 - DNA, 14 bp, synthetic construct
  source 1..14: mol_type = other DNA
aggggcttctagca

SEQ ID NO: 5179 - DNA, 14 bp, synthetic construct
  source 1..14: mol_type = other DNA
gaggatatggctaa

SEQ ID NO: 5180 - DNA, 14 bp, synthetic construct
  source 1..14: mol_type = other DNA
gtcaggcgtcatgc

SEQ ID NO: 5181 - DNA, 14 bp, synthetic construct
  source 1..14: mol_type = other DNA
tgccggtccctgcg

SEQ ID NO: 5182 - DNA, 14 bp, synthetic construct
  source 1..14: mol_type = other DNA
ccgctgcattcagc

SEQ ID NO: 5183 - DNA, 14 bp, synthetic construct
  source 1..14: mol_type = other DNA
aaaagcttgtagcg

SEQ ID NO: 5184 - DNA, 14 bp, synthetic construct
  source 1..14: mol_type = other DNA
gatgggctggtaag

SEQ ID NO: 5185 - DNA, 14 bp, synthetic construct
  source 1..14: mol_type = other DNA
cacaggcaaattct

SEQ ID NO: 5186 - DNA, 14 bp, synthetic construct
  source 1..14: mol_type = other DNA
ttgacaatacaacc

SEQ ID NO: 5187 - DNA, 14 bp, synthetic construct
  source 1..14: mol_type = other DNA
gcggattggtgaaa

SEQ ID NO: 5188 - DNA, 14 bp, synthetic construct
  source 1..14: mol_type = other DNA
atgtgcccgtcgga

SEQ ID NO: 5189 - DNA, 14 bp, synthetic construct
  source 1..14: mol_type = other DNA
gacctttggacaaa

SEQ ID NO: 5190 - DNA, 14 bp, synthetic construct
  source 1..14: mol_type = other DNA
aacgatccatctcg

SEQ ID NO: 5191 - DNA, 14 bp, synthetic construct
  source 1..14: mol_type = other DNA
caggcgattgcaat

SEQ ID NO: 5192 - DNA, 14 bp, synthetic construct
  source 1..14: mol_type = other DNA
cgagtcatcgatgg

SEQ ID NO: 5193 - DNA, 14 bp, synthetic construct
  source 1..14: mol_type = other DNA
tggaggcactggat

SEQ ID NO: 5194 - DNA, 14 bp, synthetic construct
  source 1..14: mol_type = other DNA
atcaaagtagtcca

SEQ ID NO: 5195 - DNA, 14 bp, synthetic construct
  source 1..14: mol_type = other DNA
ttgaagtgaaggcc

SEQ ID NO: 5196 - DNA, 14 bp, synthetic construct
  source 1..14: mol_type = other DNA
gtgctacatcgaac

SEQ ID NO: 5197 - DNA, 14 bp, synthetic construct
  source 1..14: mol_type = other DNA
gcggtagccccttg

SEQ ID NO: 5198 - DNA, 14 bp, synthetic construct
  source 1..14: mol_type = other DNA
gttctgaaaccgga

SEQ ID NO: 5199 - DNA, 14 bp, synthetic construct
  source 1..14: mol_type = other DNA
ttaaggaacatcaa

SEQ ID NO: 5200 - DNA, 14 bp, synthetic construct
  source 1..14: mol_type = other DNA
cacctgccagtact

SEQ ID NO: 5201 - DNA, 14 bp, synthetic construct
  source 1..14: mol_type = other DNA
ggcctgggacttac

SEQ ID NO: 5202 - DNA, 14 bp, synthetic construct
  source 1..14: mol_type = other DNA
gtaagaccgtggat

SEQ ID NO: 5203 - DNA, 14 bp, synthetic construct
  source 1..14: mol_type = other DNA
aggagacaggttgt

SEQ ID NO: 5204 - DNA, 14 bp, synthetic construct
  source 1..14: mol_type = other DNA
cagagtgctcatcc

SEQ ID NO: 5205 - DNA, 14 bp, synthetic construct
  source 1..14: mol_type = other DNA
agactccgtaccct

SEQ ID NO: 5206 - DNA, 14 bp, synthetic construct
  source 1..14: mol_type = other DNA
agattgccccaatc

SEQ ID NO: 5207 - DNA, 14 bp, synthetic construct
  source 1..14: mol_type = other DNA
ggaacggactggtt

SEQ ID NO: 5208 - DNA, 14 bp, synthetic construct
  source 1..14: mol_type = other DNA
cccagctactgact

SEQ ID NO: 5209 - DNA, 14 bp, synthetic construct
  source 1..14: mol_type = other DNA
ttctcccacgagga

SEQ ID NO: 5210 - DNA, 14 bp, synthetic construct
  source 1..14: mol_type = other DNA
cctcagaggttaac

SEQ ID NO: 5211 - DNA, 14 bp, synthetic construct
  source 1..14: mol_type = other DNA
acttcatgcgccaa

SEQ ID NO: 5212 - DNA, 14 bp, synthetic construct
  source 1..14: mol_type = other DNA
tcgactagcaacgt

SEQ ID NO: 5213 - DNA, 14 bp, synthetic construct
  source 1..14: mol_type = other DNA
gttagaagatagag

SEQ ID NO: 5214 - DNA, 14 bp, synthetic construct
  source 1..14: mol_type = other DNA
ctgactgccagagt

SEQ ID NO: 5215 - DNA, 14 bp, synthetic construct
  source 1..14: mol_type = other DNA
ttactagggcgacc

SEQ ID NO: 5216 - DNA, 14 bp, synthetic construct
  source 1..14: mol_type = other DNA
gtgccatccgcctg

SEQ ID NO: 5217 - DNA, 14 bp, synthetic construct
  source 1..14: mol_type = other DNA
cataacctcgatag

SEQ ID NO: 5218 - DNA, 14 bp, synthetic construct
  source 1..14: mol_type = other DNA
tctaaaaacgctcg

SEQ ID NO: 5219 - DNA, 14 bp, synthetic construct
  source 1..14: mol_type = other DNA
accttaagccggct

SEQ ID NO: 5220 - DNA, 14 bp, synthetic construct
  source 1..14: mol_type = other DNA
accgcgtagactta

SEQ ID NO: 5221 - DNA, 14 bp, synthetic construct
  source 1..14: mol_type = other DNA
atagagttagacgg

SEQ ID NO: 5222 - DNA, 14 bp, synthetic construct
  source 1..14: mol_type = other DNA
ttcgccagactacg

SEQ ID NO: 5223 - DNA, 14 bp, synthetic construct
  source 1..14: mol_type = other DNA
accgtacttcggcg

SEQ ID NO: 5224 - DNA, 14 bp, synthetic construct
  source 1..14: mol_type = other DNA
tatacccaactcac

SEQ ID NO: 5225 - DNA, 14 bp, synthetic construct
  source 1..14: mol_type = other DNA
tatcaccatacccc

SEQ ID NO: 5226 - DNA, 14 bp, synthetic construct
  source 1..14: mol_type = other DNA
tgggcctagcaatg

SEQ ID NO: 5227 - DNA, 14 bp, synthetic construct
  source 1..14: mol_type = other DNA
caatagtgcgcgct

SEQ ID NO: 5228 - DNA, 14 bp, synthetic construct
  source 1..14: mol_type = other DNA
aactactgggatcc

SEQ ID NO: 5229 - DNA, 14 bp, synthetic construct
  source 1..14: mol_type = other DNA
aattagggacgggt

SEQ ID NO: 5230 - DNA, 14 bp, synthetic construct
  source 1..14: mol_type = other DNA
ggattcagagcgtc

SEQ ID NO: 5231 - DNA, 14 bp, synthetic construct
  source 1..14: mol_type = other DNA
gtggctcgaaaatc

SEQ ID NO: 5232 - DNA, 14 bp, synthetic construct
  source 1..14: mol_type = other DNA
cactcacgactggt

SEQ ID NO: 5233 - DNA, 14 bp, synthetic construct
  source 1..14: mol_type = other DNA
cttatgggcaggca

SEQ ID NO: 5234 - DNA, 14 bp, synthetic construct
  source 1..14: mol_type = other DNA
cgacttacggcact

SEQ ID NO: 5235 - DNA, 14 bp, synthetic construct
  source 1..14: mol_type = other DNA
ctacacacgattgc

SEQ ID NO: 5236 - DNA, 14 bp, synthetic construct
  source 1..14: mol_type = other DNA
atcgtacacacagt

SEQ ID NO: 5237 - DNA, 14 bp, synthetic construct
  source 1..14: mol_type = other DNA
aggtaagggcagtt

SEQ ID NO: 5238 - DNA, 14 bp, synthetic construct
  source 1..14: mol_type = other DNA
tcgcgagcctgggt

SEQ ID NO: 5239 - DNA, 14 bp, synthetic construct
  source 1..14: mol_type = other DNA
agccgtccgacctt

SEQ ID NO: 5240 - DNA, 14 bp, synthetic construct
  source 1..14: mol_type = other DNA
agaccggtatggat

SEQ ID NO: 5241 - DNA, 14 bp, synthetic construct
  source 1..14: mol_type = other DNA
agtaaacaactctc

SEQ ID NO: 5242 - DNA, 14 bp, synthetic construct
  source 1..14: mol_type = other DNA
caaacgccttcatc

SEQ ID NO: 5243 - DNA, 14 bp, synthetic construct
  source 1..14: mol_type = other DNA
cgacccagtcactt

SEQ ID NO: 5244 - DNA, 14 bp, synthetic construct
  source 1..14: mol_type = other DNA
caccagatactgtg

SEQ ID NO: 5245 - DNA, 14 bp, synthetic construct
  source 1..14: mol_type = other DNA
cttgacgctcggag

SEQ ID NO: 5246 - DNA, 14 bp, synthetic construct
  source 1..14: mol_type = other DNA
taagcgggatgtaa

SEQ ID NO: 5247 - DNA, 14 bp, synthetic construct
  source 1..14: mol_type = other DNA
cagctaggttaaag

SEQ ID NO: 5248 - DNA, 14 bp, synthetic construct
  source 1..14: mol_type = other DNA
caaaacgatttgcc

SEQ ID NO: 5249 - DNA, 14 bp, synthetic construct
  source 1..14: mol_type = other DNA
cttggaggggggta

SEQ ID NO: 5250 - DNA, 14 bp, synthetic construct
  source 1..14: mol_type = other DNA
aggcctagttaaga

SEQ ID NO: 5251 - DNA, 14 bp, synthetic construct
  source 1..14: mol_type = other DNA
gctgcctggtcaga

SEQ ID NO: 5252 - DNA, 14 bp, synthetic construct
  source 1..14: mol_type = other DNA
tccgataaataggg

SEQ ID NO: 5253 - DNA, 14 bp, synthetic construct
  source 1..14: mol_type = other DNA
cgtgcaatcactgg

SEQ ID NO: 5254 - DNA, 14 bp, synthetic construct
  source 1..14: mol_type = other DNA
acattgcccagtcg

SEQ ID NO: 5255 - DNA, 14 bp, synthetic construct
  source 1..14: mol_type = other DNA
accgtacctgagat

SEQ ID NO: 5256 - DNA, 14 bp, synthetic construct
  source 1..14: mol_type = other DNA
gcgcgtgttaaggc

SEQ ID NO: 5257 - DNA, 14 bp, synthetic construct
  source 1..14: mol_type = other DNA
acaggtctctcagc

SEQ ID NO: 5258 - DNA, 14 bp, synthetic construct
  source 1..14: mol_type = other DNA
gaagtagagtcctg

SEQ ID NO: 5259 - DNA, 14 bp, synthetic construct
  source 1..14: mol_type = other DNA
gtgacctccgaaat

SEQ ID NO: 5260 - DNA, 14 bp, synthetic construct
  source 1..14: mol_type = other DNA
acggtcctgatgca

SEQ ID NO: 5261 - DNA, 14 bp, synthetic construct
  source 1..14: mol_type = other DNA
tggacgcttgaaaa

SEQ ID NO: 5262 - DNA, 14 bp, synthetic construct
  source 1..14: mol_type = other DNA
cgtgtcgcaggtca

SEQ ID NO: 5263 - DNA, 14 bp, synthetic construct
  source 1..14: mol_type = other DNA
acggtcaggctgat

SEQ ID NO: 5264 - DNA, 14 bp, synthetic construct
  source 1..14: mol_type = other DNA
tccgacgtactcag

SEQ ID NO: 5265 - DNA, 14 bp, synthetic construct
  source 1..14: mol_type = other DNA
ctcgcaaaatatac

SEQ ID NO: 5266 - DNA, 14 bp, synthetic construct
  source 1..14: mol_type = other DNA
aagctttaacacca

SEQ ID NO: 5267 - DNA, 14 bp, synthetic construct
  source 1..14: mol_type = other DNA
gcggctagcgtctc

SEQ ID NO: 5268 - DNA, 14 bp, synthetic construct
  source 1..14: mol_type = other DNA
tggatccctcagga

SEQ ID NO: 5269 - DNA, 14 bp, synthetic construct
  source 1..14: mol_type = other DNA
ctcaggctctacac

SEQ ID NO: 5270 - DNA, 14 bp, synthetic construct
  source 1..14: mol_type = other DNA
tcctgggaccaaat

SEQ ID NO: 5271 - DNA, 14 bp, synthetic construct
  source 1..14: mol_type = other DNA
aggtagccctctgc

SEQ ID NO: 5272 - DNA, 14 bp, synthetic construct
  source 1..14: mol_type = other DNA
ggacgtttacagac

SEQ ID NO: 5273 - DNA, 14 bp, synthetic construct
  source 1..14: mol_type = other DNA
acttgcgctgggac

SEQ ID NO: 5274 - DNA, 14 bp, synthetic construct
  source 1..14: mol_type = other DNA
acgattgagccaat

SEQ ID NO: 5275 - DNA, 14 bp, synthetic construct
  source 1..14: mol_type = other DNA
agattgcaccgcgt

SEQ ID NO: 5276 - DNA, 14 bp, synthetic construct
  source 1..14: mol_type = other DNA
gaccgctcgttggc

SEQ ID NO: 5277 - DNA, 14 bp, synthetic construct
  source 1..14: mol_type = other DNA
tcacaagtatacgc

SEQ ID NO: 5278 - DNA, 14 bp, synthetic construct
  source 1..14: mol_type = other DNA
ccggctaagtcggt

SEQ ID NO: 5279 - DNA, 14 bp, synthetic construct
  source 1..14: mol_type = other DNA
ggataatgaggctc

SEQ ID NO: 5280 - DNA, 14 bp, synthetic construct
  source 1..14: mol_type = other DNA
actgagcccagtgt

SEQ ID NO: 5281 - DNA, 14 bp, synthetic construct
  source 1..14: mol_type = other DNA
cagattaacaaggt

SEQ ID NO: 5282 - DNA, 14 bp, synthetic construct
  source 1..14: mol_type = other DNA
atggacgaccgttc

SEQ ID NO: 5283 - DNA, 14 bp, synthetic construct
  source 1..14: mol_type = other DNA
ggggactcctctca

SEQ ID NO: 5284 - DNA, 14 bp, synthetic construct
  source 1..14: mol_type = other DNA
ccaaaagtgattga

SEQ ID NO: 5285 - DNA, 14 bp, synthetic construct
  source 1..14: mol_type = other DNA
ggcgagttcgcctc

SEQ ID NO: 5286 - DNA, 14 bp, synthetic construct
  source 1..14: mol_type = other DNA
atcgtacaatgcaa

SEQ ID NO: 5287 - DNA, 14 bp, synthetic construct
  source 1..14: mol_type = other DNA
agaagtattagctc

SEQ ID NO: 5288 - DNA, 14 bp, synthetic construct
  source 1..14: mol_type = other DNA
cgccgattattaaa

SEQ ID NO: 5289 - DNA, 14 bp, synthetic construct
  source 1..14: mol_type = other DNA
tgcagtatcgccgt

SEQ ID NO: 5290 - DNA, 14 bp, synthetic construct
  source 1..14: mol_type = other DNA
ctaatatcaatgca

SEQ ID NO: 5291 - DNA, 14 bp, synthetic construct
  source 1..14: mol_type = other DNA
ggggatgatggtct

SEQ ID NO: 5292 - DNA, 14 bp, synthetic construct
  source 1..14: mol_type = other DNA
tgtgcgcgaatctg

SEQ ID NO: 5293 - DNA, 14 bp, synthetic construct
  source 1..14: mol_type = other DNA
ccgcttgttgcaac

SEQ ID NO: 5294 - DNA, 14 bp, synthetic construct
  source 1..14: mol_type = other DNA
cattgggggtatca

SEQ ID NO: 5295 - DNA, 14 bp, synthetic construct
  source 1..14: mol_type = other DNA
cataaatcaagatt

SEQ ID NO: 5296 - DNA, 14 bp, synthetic construct
  source 1..14: mol_type = other DNA
ggccgtagtctctg

SEQ ID NO: 5297 - DNA, 14 bp, synthetic construct
  source 1..14: mol_type = other DNA
tatatggactaaac

SEQ ID NO: 5298 - DNA, 14 bp, synthetic construct
  source 1..14: mol_type = other DNA
taaactcctccagt

SEQ ID NO: 5299 - DNA, 14 bp, synthetic construct
  source 1..14: mol_type = other DNA
ctcgggtaatgtcc

SEQ ID NO: 5300 - DNA, 14 bp, synthetic construct
  source 1..14: mol_type = other DNA
gtatgtaggaccgt

SEQ ID NO: 5301 - DNA, 14 bp, synthetic construct
  source 1..14: mol_type = other DNA
ctccatacgttaaa

SEQ ID NO: 5302 - DNA, 14 bp, synthetic construct
  source 1..14: mol_type = other DNA
attgcagcccactt

SEQ ID NO: 5303 - DNA, 14 bp, synthetic construct
  source 1..14: mol_type = other DNA
cacatctccgactt

SEQ ID NO: 5304 - DNA, 14 bp, synthetic construct
  source 1..14: mol_type = other DNA
actcagcggtatgt

SEQ ID NO: 5305 - DNA, 14 bp, synthetic construct
  source 1..14: mol_type = other DNA
atagatcgtgagta

SEQ ID NO: 5306 - DNA, 14 bp, synthetic construct
  source 1..14: mol_type = other DNA
ttcagccatcgctg

SEQ ID NO: 5307 - DNA, 14 bp, synthetic construct
  source 1..14: mol_type = other DNA
gtctatgccgtagc

SEQ ID NO: 5308 - DNA, 14 bp, synthetic construct
  source 1..14: mol_type = other DNA
gccgtagttgtgcc

SEQ ID NO: 5309 - DNA, 14 bp, synthetic construct
  source 1..14: mol_type = other DNA
actgcgcgtctagt

SEQ ID NO: 5310 - DNA, 14 bp, synthetic construct
  source 1..14: mol_type = other DNA
tctgagttaaaggg

SEQ ID NO: 5311 - DNA, 14 bp, synthetic construct
  source 1..14: mol_type = other DNA
ccacgcttggatat

SEQ ID NO: 5312 - DNA, 14 bp, synthetic construct
  source 1..14: mol_type = other DNA
tgtcaatcagcatg

SEQ ID NO: 5313 - DNA, 14 bp, synthetic construct
  source 1..14: mol_type = other DNA
actattggtaaacg

SEQ ID NO: 5314 - DNA, 14 bp, synthetic construct
  source 1..14: mol_type = other DNA
tcgcaatgattgaa

SEQ ID NO: 5315 - DNA, 14 bp, synthetic construct
  source 1..14: mol_type = other DNA
tcttccggactaag

SEQ ID NO: 5316 - DNA, 14 bp, synthetic construct
  source 1..14: mol_type = other DNA
tcctggttccacca

SEQ ID NO: 5317 - DNA, 14 bp, synthetic construct
  source 1..14: mol_type = other DNA
ctgattaggtagaa

SEQ ID NO: 5318 - DNA, 14 bp, synthetic construct
  source 1..14: mol_type = other DNA
gtgtcatggctaag

SEQ ID NO: 5319 - DNA, 14 bp, synthetic construct
  source 1..14: mol_type = other DNA
acgacctctaagtt

SEQ ID NO: 5320 - DNA, 14 bp, synthetic construct
  source 1..14: mol_type = other DNA
cctagtagatgtca

SEQ ID NO: 5321 - DNA, 14 bp, synthetic construct
  source 1..14: mol_type = other DNA
aagtagttgaaatc

SEQ ID NO: 5322 - DNA, 14 bp, synthetic construct
  source 1..14: mol_type = other DNA
acttctgacaatgg

SEQ ID NO: 5323 - DNA, 14 bp, synthetic construct
  source 1..14: mol_type = other DNA
ccgaattaataggt

SEQ ID NO: 5324 - DNA, 14 bp, synthetic construct
  source 1..14: mol_type = other DNA
taccgaatcaattg

SEQ ID NO: 5325 - DNA, 14 bp, synthetic construct
  source 1..14: mol_type = other DNA
gtcgacgtggcgtt

SEQ ID NO: 5326 - DNA, 14 bp, synthetic construct
  source 1..14: mol_type = other DNA
tgtaatgcgagtag

SEQ ID NO: 5327 - DNA, 14 bp, synthetic construct
  source 1..14: mol_type = other DNA
attagttcgccagg

SEQ ID NO: 5328 - DNA, 14 bp, synthetic construct
  source 1..14: mol_type = other DNA
gtcacctgtcgata

SEQ ID NO: 5329 - DNA, 14 bp, synthetic construct
  source 1..14: mol_type = other DNA
tttgaaagccatag

SEQ ID NO: 5330 - DNA, 14 bp, synthetic construct
  source 1..14: mol_type = other DNA
aaccgtgtcctgtg

SEQ ID NO: 5331 - DNA, 14 bp, synthetic construct
  source 1..14: mol_type = other DNA
ggtgcttctgagcg

SEQ ID NO: 5332 - DNA, 14 bp, synthetic construct
  source 1..14: mol_type = other DNA
actgtctgtcccac

SEQ ID NO: 5333 - DNA, 14 bp, synthetic construct
  source 1..14: mol_type = other DNA
actagtactcatga

SEQ ID NO: 5334 - DNA, 14 bp, synthetic construct
  source 1..14: mol_type = other DNA
actctggtctcgag

SEQ ID NO: 5335 - DNA, 14 bp, synthetic construct
  source 1..14: mol_type = other DNA
ctacagcatgctgt

SEQ ID NO: 5336 - DNA, 14 bp, synthetic construct
  source 1..14: mol_type = other DNA
gtgtctcagggatg

SEQ ID NO: 5337 - DNA, 14 bp, synthetic construct
  source 1..14: mol_type = other DNA
cgggtgtggtgctc

SEQ ID NO: 5338 - DNA, 14 bp, synthetic construct
  source 1..14: mol_type = other DNA
cagtggtcacactt

SEQ ID NO: 5339 - DNA, 14 bp, synthetic construct
  source 1..14: mol_type = other DNA
gcctccgcgtcttg

SEQ ID NO: 5340 - DNA, 14 bp, synthetic construct
  source 1..14: mol_type = other DNA
tgtacgtcccatgc

SEQ ID NO: 5341 - DNA, 14 bp, synthetic construct
  source 1..14: mol_type = other DNA
ggaataccatgtct

SEQ ID NO: 5342 - DNA, 14 bp, synthetic construct
  source 1..14: mol_type = other DNA
gcctgatatcatcc

SEQ ID NO: 5343 - DNA, 14 bp, synthetic construct
  source 1..14: mol_type = other DNA
ggattcgtgccggt

SEQ ID NO: 5344 - DNA, 14 bp, synthetic construct
  source 1..14: mol_type = other DNA
tctaggcggtgata

SEQ ID NO: 5345 - DNA, 14 bp, synthetic construct
  source 1..14: mol_type = other DNA
aatctcaaccgtat

SEQ ID NO: 5346 - DNA, 14 bp, synthetic construct
  source 1..14: mol_type = other DNA
ataacacttccgtg

SEQ ID NO: 5347 - DNA, 14 bp, synthetic construct
  source 1..14: mol_type = other DNA
tctgtaccgcgtcc

SEQ ID NO: 5348 - DNA, 14 bp, synthetic construct
  source 1..14: mol_type = other DNA
attgcatatacgac

SEQ ID NO: 5349 - DNA, 14 bp, synthetic construct
  source 1..14: mol_type = other DNA
gtggggaagtatta

SEQ ID NO: 5350 - DNA, 14 bp, synthetic construct
  source 1..14: mol_type = other DNA
tatgaggcctgtgg

SEQ ID NO: 5351 - DNA, 14 bp, synthetic construct
  source 1..14: mol_type = other DNA
ggtagcttcctggg

SEQ ID NO: 5352 - DNA, 14 bp, synthetic construct
  source 1..14: mol_type = other DNA
taatcgatatagcc

SEQ ID NO: 5353 - DNA, 14 bp, synthetic construct
  source 1..14: mol_type = other DNA
aagctcgcctcttc

SEQ ID NO: 5354 - DNA, 14 bp, synthetic construct
  source 1..14: mol_type = other DNA
tatagtataacgca

SEQ ID NO: 5355 - DNA, 14 bp, synthetic construct
  source 1..14: mol_type = other DNA
tcgtcagcggatgt

SEQ ID NO: 5356 - DNA, 14 bp, synthetic construct
  source 1..14: mol_type = other DNA
cactcttgccgatc

SEQ ID NO: 5357 - DNA, 14 bp, synthetic construct
  source 1..14: mol_type = other DNA
tttcagctccgaca

SEQ ID NO: 5358 - DNA, 14 bp, synthetic construct
  source 1..14: mol_type = other DNA
cataccaacttaat

SEQ ID NO: 5359 - DNA, 14 bp, synthetic construct
  source 1..14: mol_type = other DNA
tcgtaatggcctcc

SEQ ID NO: 5360 - DNA, 14 bp, synthetic construct
  source 1..14: mol_type = other DNA
gctgcgtagaatat

SEQ ID NO: 5361 - DNA, 14 bp, synthetic construct
  source 1..14: mol_type = other DNA
tattgccaactagg

SEQ ID NO: 5362 - DNA, 14 bp, synthetic construct
  source 1..14: mol_type = other DNA
gtccctcgcgatct

SEQ ID NO: 5363 - DNA, 14 bp, synthetic construct
  source 1..14: mol_type = other DNA
gcattgtccactgc

SEQ ID NO: 5364 - DNA, 14 bp, synthetic construct
  source 1..14: mol_type = other DNA
cttgcacggtcctg

SEQ ID NO: 5365 - DNA, 14 bp, synthetic construct
  source 1..14: mol_type = other DNA
ggctgtgtccccct

SEQ ID NO: 5366 - DNA, 14 bp, synthetic construct
  source 1..14: mol_type = other DNA
gagtgattcgtcgg

SEQ ID NO: 5367 - DNA, 14 bp, synthetic construct
  source 1..14: mol_type = other DNA
ttcccgtctacagg

SEQ ID NO: 5368 - DNA, 14 bp, synthetic construct
  source 1..14: mol_type = other DNA
catattcagcgcta

SEQ ID NO: 5369 - DNA, 14 bp, synthetic construct
  source 1..14: mol_type = other DNA
gtgttcaccgctgg

SEQ ID NO: 5370 - DNA, 14 bp, synthetic construct
  source 1..14: mol_type = other DNA
tagacggtgtacgt

SEQ ID NO: 5371 - DNA, 14 bp, synthetic construct
  source 1..14: mol_type = other DNA
cttggcaagttgaa

SEQ ID NO: 5372 - DNA, 14 bp, synthetic construct
  source 1..14: mol_type = other DNA
gctgagatagttgg

SEQ ID NO: 5373 - DNA, 14 bp, synthetic construct
  source 1..14: mol_type = other DNA
tgccattcgacagt

SEQ ID NO: 5374 - DNA, 14 bp, synthetic construct
  source 1..14: mol_type = other DNA
aatgtgtgaactgg

SEQ ID NO: 5375 - DNA, 14 bp, synthetic construct
  source 1..14: mol_type = other DNA
ctctgaccccggtt

SEQ ID NO: 5376 - DNA, 14 bp, synthetic construct
  source 1..14: mol_type = other DNA
atatacgaatgatg

SEQ ID NO: 5377 - DNA, 14 bp, synthetic construct
  source 1..14: mol_type = other DNA
ctctccttgcaaag

SEQ ID NO: 5378 - DNA, 14 bp, synthetic construct
  source 1..14: mol_type = other DNA
gggtagttcggata

SEQ ID NO: 5379 - DNA, 14 bp, synthetic construct
  source 1..14: mol_type = other DNA
tagtttcgcgggag

SEQ ID NO: 5380 - DNA, 14 bp, synthetic construct
  source 1..14: mol_type = other DNA
cgactttactgagc

SEQ ID NO: 5381 - DNA, 14 bp, synthetic construct
  source 1..14: mol_type = other DNA
tctgacgaagctta

SEQ ID NO: 5382 - DNA, 14 bp, synthetic construct
  source 1..14: mol_type = other DNA
catcggcctttggg

SEQ ID NO: 5383 - DNA, 14 bp, synthetic construct
  source 1..14: mol_type = other DNA
aactccccctctct

SEQ ID NO: 5384 - DNA, 14 bp, synthetic construct
  source 1..14: mol_type = other DNA
gtcaaaattatcgg

SEQ ID NO: 5385 - DNA, 14 bp, synthetic construct
  source 1..14: mol_type = other DNA
ttggggattaggaa

SEQ ID NO: 5386 - DNA, 14 bp, synthetic construct
  source 1..14: mol_type = other DNA
tactggtcagtcca

SEQ ID NO: 5387 - DNA, 14 bp, synthetic construct
  source 1..14: mol_type = other DNA
cgttgtcataagaa

SEQ ID NO: 5388 - DNA, 14 bp, synthetic construct
  source 1..14: mol_type = other DNA
tttcggggtaacca

SEQ ID NO: 5389 - DNA, 14 bp, synthetic construct
  source 1..14: mol_type = other DNA
atgtaccatgtaac

SEQ ID NO: 5390 - DNA, 14 bp, synthetic construct
  source 1..14: mol_type = other DNA
tgaagacacatttc

SEQ ID NO: 5391 - DNA, 14 bp, synthetic construct
  source 1..14: mol_type = other DNA
gagtgaaataattg

SEQ ID NO: 5392 - DNA, 14 bp, synthetic construct
  source 1..14: mol_type = other DNA
gcgtgtatgataaa

SEQ ID NO: 5393 - DNA, 14 bp, synthetic construct
  source 1..14: mol_type = other DNA
gaactaaatacttc

SEQ ID NO: 5394 - DNA, 14 bp, synthetic construct
  source 1..14: mol_type = other DNA
ccgcttctcatgag

SEQ ID NO: 5395 - DNA, 14 bp, synthetic construct
  source 1..14: mol_type = other DNA
ttacccttacgaga

SEQ ID NO: 5396 - DNA, 14 bp, synthetic construct
  source 1..14: mol_type = other DNA
ccttacttgacaac

SEQ ID NO: 5397 - DNA, 14 bp, synthetic construct
  source 1..14: mol_type = other DNA
tacttcgacgcatg

SEQ ID NO: 5398 - DNA, 14 bp, synthetic construct
  source 1..14: mol_type = other DNA
aacaatttctcacg

SEQ ID NO: 5399 - DNA, 14 bp, synthetic construct
  source 1..14: mol_type = other DNA
gcttgacctcgggt

SEQ ID NO: 5400 - DNA, 14 bp, synthetic construct
  source 1..14: mol_type = other DNA
acgtgttggacggt

SEQ ID NO: 5401 - DNA, 14 bp, synthetic construct
  source 1..14: mol_type = other DNA
aaagccaacttctt

SEQ ID NO: 5402 - DNA, 14 bp, synthetic construct
  source 1..14: mol_type = other DNA
ttcagtcagtacgc

SEQ ID NO: 5403 - DNA, 14 bp, synthetic construct
  source 1..14: mol_type = other DNA
cagctcatctacat

SEQ ID NO: 5404 - DNA, 14 bp, synthetic construct
  source 1..14: mol_type = other DNA
atttgacaccagta

SEQ ID NO: 5405 - DNA, 14 bp, synthetic construct
  source 1..14: mol_type = other DNA
actttcggggtaca

SEQ ID NO: 5406 - DNA, 14 bp, synthetic construct
  source 1..14: mol_type = other DNA
gactttctccgacc

SEQ ID NO: 5407 - DNA, 14 bp, synthetic construct
  source 1..14: mol_type = other DNA
agaattcataggct

SEQ ID NO: 5408 - DNA, 14 bp, synthetic construct
  source 1..14: mol_type = other DNA
aagtttcggaacat

SEQ ID NO: 5409 - DNA, 14 bp, synthetic construct
  source 1..14: mol_type = other DNA
gttaaaccatcgtg

SEQ ID NO: 5410 - DNA, 14 bp, synthetic construct
  source 1..14: mol_type = other DNA
cctacgacttataa

SEQ ID NO: 5411 - DNA, 14 bp, synthetic construct
  source 1..14: mol_type = other DNA
agtgtttgcgacgc

SEQ ID NO: 5412 - DNA, 14 bp, synthetic construct
  source 1..14: mol_type = other DNA
gagctatgtatccg

SEQ ID NO: 5413 - DNA, 14 bp, synthetic construct
  source 1..14: mol_type = other DNA
gtcaacattaatac

SEQ ID NO: 5414 - DNA, 14 bp, synthetic construct
  source 1..14: mol_type = other DNA
gagctttggaagtc

SEQ ID NO: 5415 - DNA, 14 bp, synthetic construct
  source 1..14: mol_type = other DNA
gtgtcgatcagcat

SEQ ID NO: 5416 - DNA, 14 bp, synthetic construct
  source 1..14: mol_type = other DNA
gctattgggcatag

SEQ ID NO: 5417 - DNA, 14 bp, synthetic construct
  source 1..14: mol_type = other DNA
catttccggtgaaa

SEQ ID NO: 5418 - DNA, 14 bp, synthetic construct
  source 1..14: mol_type = other DNA
ggtctgtgtagggc

SEQ ID NO: 5419 - DNA, 14 bp, synthetic construct
  source 1..14: mol_type = other DNA
attgacagtagcgt

SEQ ID NO: 5420 - DNA, 14 bp, synthetic construct
  source 1..14: mol_type = other DNA
aacagctgtttacc

SEQ ID NO: 5421 - DNA, 14 bp, synthetic construct
  source 1..14: mol_type = other DNA
ctctgcgaggattc

SEQ ID NO: 5422 - DNA, 14 bp, synthetic construct
  source 1..14: mol_type = other DNA
aaattgagagtcat

SEQ ID NO: 5423 - DNA, 14 bp, synthetic construct
  source 1..14: mol_type = other DNA
aggatatctacgtc

SEQ ID NO: 5424 - DNA, 14 bp, synthetic construct
  source 1..14: mol_type = other DNA
aacgtgatattaag

SEQ ID NO: 5425 - DNA, 14 bp, synthetic construct
  source 1..14: mol_type = other DNA
aattacagatcctc

SEQ ID NO: 5426 - DNA, 14 bp, synthetic construct
  source 1..14: mol_type = other DNA
tgctgttaggcaag

SEQ ID NO: 5427 - DNA, 14 bp, synthetic construct
  source 1..14: mol_type = other DNA
aaaagtcctttcaa

SEQ ID NO: 5428 - DNA, 14 bp, synthetic construct
  source 1..14: mol_type = other DNA
tagtacgctaggct

SEQ ID NO: 5429 - DNA, 14 bp, synthetic construct
  source 1..14: mol_type = other DNA
taggacctgtctca

SEQ ID NO: 5430 - DNA, 14 bp, synthetic construct
  source 1..14: mol_type = other DNA
atggttcgggtagg

SEQ ID NO: 5431 - DNA, 14 bp, synthetic construct
  source 1..14: mol_type = other DNA
cataaaggggttta

SEQ ID NO: 5432 - DNA, 14 bp, synthetic construct
  source 1..14: mol_type = other DNA
ggcgtgactattgc

SEQ ID NO: 5433 - DNA, 14 bp, synthetic construct
  source 1..14: mol_type = other DNA
gacgttcactcgat

SEQ ID NO: 5434 - DNA, 14 bp, synthetic construct
  source 1..14: mol_type = other DNA
gacatttgagataa

SEQ ID NO: 5435 - DNA, 14 bp, synthetic construct
  source 1..14: mol_type = other DNA
gacgaccctttgtc

SEQ ID NO: 5436 - DNA, 14 bp, synthetic construct
  source 1..14: mol_type = other DNA
tgggctgttacaag

SEQ ID NO: 5437 - DNA, 14 bp, synthetic construct
  source 1..14: mol_type = other DNA
attcaatgatccgg

SEQ ID NO: 5438 - DNA, 14 bp, synthetic construct
  source 1..14: mol_type = other DNA
aagaagcttattgg

SEQ ID NO: 5439 - DNA, 14 bp, synthetic construct
  source 1..14: mol_type = other DNA
cggaactgttcggt

SEQ ID NO: 5440 - DNA, 14 bp, synthetic construct
  source 1..14: mol_type = other DNA
tcggtcaacattcc

SEQ ID NO: 5441 - DNA, 14 bp, synthetic construct
  source 1..14: mol_type = other DNA
ttgaccctcactga

SEQ ID NO: 5442 - DNA, 14 bp, synthetic construct
  source 1..14: mol_type = other DNA
tcccgatcagttag

SEQ ID NO: 5443 - DNA, 14 bp, synthetic construct
  source 1..14: mol_type = other DNA
cttctcaagactcg

SEQ ID NO: 5444 - DNA, 14 bp, synthetic construct
  source 1..14: mol_type = other DNA
attatcccaactcc

SEQ ID NO: 5445 - DNA, 14 bp, synthetic construct
  source 1..14: mol_type = other DNA
tagctacactgcct

SEQ ID NO: 5446 - DNA, 14 bp, synthetic construct
  source 1..14: mol_type = other DNA
ctggggttgaatag

SEQ ID NO: 5447 - DNA, 14 bp, synthetic construct
  source 1..14: mol_type = other DNA
ctctgtccgataca

SEQ ID NO: 5448 - DNA, 14 bp, synthetic construct
  source 1..14: mol_type = other DNA
catggtggttcgcg

SEQ ID NO: 5449 - DNA, 14 bp, synthetic construct
  source 1..14: mol_type = other DNA
gcaacagtaatttg

SEQ ID NO: 5450 - DNA, 14 bp, synthetic construct
  source 1..14: mol_type = other DNA
gtgcagcttgtcgc

SEQ ID NO: 5451 - DNA, 14 bp, synthetic construct
  source 1..14: mol_type = other DNA
tcctacttagcaaa

SEQ ID NO: 5452 - DNA, 14 bp, synthetic construct
  source 1..14: mol_type = other DNA
ataaaaagtgtcgt

SEQ ID NO: 5453 - DNA, 14 bp, synthetic construct
  source 1..14: mol_type = other DNA
gatactcgctgatc

SEQ ID NO: 5454 - DNA, 14 bp, synthetic construct
  source 1..14: mol_type = other DNA
cactcttagacggt

SEQ ID NO: 5455 - DNA, 14 bp, synthetic construct
  source 1..14: mol_type = other DNA
tgccctggaggtct

SEQ ID NO: 5456 - DNA, 14 bp, synthetic construct
  source 1..14: mol_type = other DNA
agtgaatatgatac

SEQ ID NO: 5457 - DNA, 14 bp, synthetic construct
  source 1..14: mol_type = other DNA
ccttgggcctcgct

SEQ ID NO: 5458 - DNA, 14 bp, synthetic construct
  source 1..14: mol_type = other DNA
tacgatgcgcgatt

SEQ ID NO: 5459 - DNA, 14 bp, synthetic construct
  source 1..14: mol_type = other DNA
cccatcgtcgcttg

SEQ ID NO: 5460 - DNA, 14 bp, synthetic construct
  source 1..14: mol_type = other DNA
agttgggtcggact

SEQ ID NO: 5461 - DNA, 14 bp, synthetic construct
  source 1..14: mol_type = other DNA
cattgctcaactga

SEQ ID NO: 5462 - DNA, 14 bp, synthetic construct
  source 1..14: mol_type = other DNA
caagagatgtattc

SEQ ID NO: 5463 - DNA, 14 bp, synthetic construct
  source 1..14: mol_type = other DNA
gagaatagcatttg

SEQ ID NO: 5464 - DNA, 14 bp, synthetic construct
  source 1..14: mol_type = other DNA
cgccacttgtaggt

SEQ ID NO: 5465 - DNA, 14 bp, synthetic construct
  source 1..14: mol_type = other DNA
ctacctataacgat

SEQ ID NO: 5466 - DNA, 14 bp, synthetic construct
  source 1..14: mol_type = other DNA
aatttggtcggcag

SEQ ID NO: 5467 - DNA, 14 bp, synthetic construct
  source 1..14: mol_type = other DNA
cgcaggtctgggtt

SEQ ID NO: 5468 - DNA, 14 bp, synthetic construct
  source 1..14: mol_type = other DNA
aagtaagtacttgg

SEQ ID NO: 5469 - DNA, 14 bp, synthetic construct
  source 1..14: mol_type = other DNA
cgtaaaatatcctc

SEQ ID NO: 5470 - DNA, 14 bp, synthetic construct
  source 1..14: mol_type = other DNA
ttagtagcctcacg

SEQ ID NO: 5471 - DNA, 14 bp, synthetic construct
  source 1..14: mol_type = other DNA
cactggggtgtgct

SEQ ID NO: 5472 - DNA, 14 bp, synthetic construct
  source 1..14: mol_type = other DNA
ttgtgtcggggaac

SEQ ID NO: 5473 - DNA, 14 bp, synthetic construct
  source 1..14: mol_type = other DNA
tacgtattcgggcg

SEQ ID NO: 5474 - DNA, 14 bp, synthetic construct
  source 1..14: mol_type = other DNA
cggagctttactag

SEQ ID NO: 5475 - DNA, 14 bp, synthetic construct
  source 1..14: mol_type = other DNA
acggagcttatgat

SEQ ID NO: 5476 - DNA, 14 bp, synthetic construct
  source 1..14: mol_type = other DNA
ctgtctgtgcgaaa

SEQ ID NO: 5477 - DNA, 14 bp, synthetic construct
  source 1..14: mol_type = other DNA
gtgtggtatagcca

SEQ ID NO: 5478 - DNA, 14 bp, synthetic construct
  source 1..14: mol_type = other DNA
gatcgtctcaggtc

SEQ ID NO: 5479 - DNA, 14 bp, synthetic construct
  source 1..14: mol_type = other DNA
gacgggctcccttt

SEQ ID NO: 5480 - DNA, 14 bp, synthetic construct
  source 1..14: mol_type = other DNA
aactaatgttgcag

SEQ ID NO: 5481 - DNA, 14 bp, synthetic construct
  source 1..14: mol_type = other DNA
ttacctggccctca

SEQ ID NO: 5482 - DNA, 14 bp, synthetic construct
  source 1..14: mol_type = other DNA
gtgtcagtgcggtg

SEQ ID NO: 5483 - DNA, 14 bp, synthetic construct
  source 1..14: mol_type = other DNA
tgcggtcaactata

SEQ ID NO: 5484 - DNA, 14 bp, synthetic construct
  source 1..14: mol_type = other DNA
tgacgcttcactga

SEQ ID NO: 5485 - DNA, 14 bp, synthetic construct
  source 1..14: mol_type = other DNA
tagacgtagattaa

SEQ ID NO: 5486 - DNA, 14 bp, synthetic construct
  source 1..14: mol_type = other DNA
tggagcacatgtta

SEQ ID NO: 5487 - DNA, 14 bp, synthetic construct
  source 1..14: mol_type = other DNA
tgtacgcccacatt

SEQ ID NO: 5488 - DNA, 14 bp, synthetic construct
  source 1..14: mol_type = other DNA
gcccctgatcgttg

SEQ ID NO: 5489 - DNA, 14 bp, synthetic construct
  source 1..14: mol_type = other DNA
ttgggttacagcag

SEQ ID NO: 5490 - DNA, 14 bp, synthetic construct
  source 1..14: mol_type = other DNA
gtgtcgctacagct

SEQ ID NO: 5491 - DNA, 14 bp, synthetic construct
  source 1..14: mol_type = other DNA
tgccaattcagtaa

SEQ ID NO: 5492 - DNA, 14 bp, synthetic construct
  source 1..14: mol_type = other DNA
gcgacttcgtatac

SEQ ID NO: 5493 - DNA, 14 bp, synthetic construct
  source 1..14: mol_type = other DNA
caagccacgtgttt

SEQ ID NO: 5494 - DNA, 14 bp, synthetic construct
  source 1..14: mol_type = other DNA
cagtctcgattacc

SEQ ID NO: 5495 - DNA, 14 bp, synthetic construct
  source 1..14: mol_type = other DNA
gaatagacatctat

SEQ ID NO: 5496 - DNA, 14 bp, synthetic construct
  source 1..14: mol_type = other DNA
aggcgtattagtcg

SEQ ID NO: 5497 - DNA, 14 bp, synthetic construct
  source 1..14: mol_type = other DNA
ttgacggtcgtcca

SEQ ID NO: 5498 - DNA, 14 bp, synthetic construct
  source 1..14: mol_type = other DNA
cataatgtaactaa

SEQ ID NO: 5499 - DNA, 14 bp, synthetic construct
  source 1..14: mol_type = other DNA
aaagtcgttcgtaa

SEQ ID NO: 5500 - DNA, 14 bp, synthetic construct
  source 1..14: mol_type = other DNA
gaagttgtctgcac

SEQ ID NO: 5501 - DNA, 14 bp, synthetic construct
  source 1..14: mol_type = other DNA
ttaaacatacccta

SEQ ID NO: 5502 - DNA, 14 bp, synthetic construct
  source 1..14: mol_type = other DNA
ttatcagcgagagt

SEQ ID NO: 5503 - DNA, 14 bp, synthetic construct
  source 1..14: mol_type = other DNA
aacaaattcgctgt

SEQ ID NO: 5504 - DNA, 14 bp, synthetic construct
  source 1..14: mol_type = other DNA
cgccaactcatttc

SEQ ID NO: 5505 - DNA, 14 bp, synthetic construct
  source 1..14: mol_type = other DNA
gcatatctgcacct

SEQ ID NO: 5506 - DNA, 14 bp, synthetic construct
  source 1..14: mol_type = other DNA
agtcggtcatgcgt

SEQ ID NO: 5507 - DNA, 14 bp, synthetic construct
  source 1..14: mol_type = other DNA
cggtgacgttaaat

SEQ ID NO: 5508 - DNA, 14 bp, synthetic construct
  source 1..14: mol_type = other DNA
gataattcgcgcat

SEQ ID NO: 5509 - DNA, 14 bp, synthetic construct
  source 1..14: mol_type = other DNA
actaatctaaccct

SEQ ID NO: 5510 - DNA, 14 bp, synthetic construct
  source 1..14: mol_type = other DNA
gtccgttcgtagca

SEQ ID NO: 5511 - DNA, 14 bp, synthetic construct
  source 1..14: mol_type = other DNA
ggaattccgatgtg

SEQ ID NO: 5512 - DNA, 14 bp, synthetic construct
  source 1..14: mol_type = other DNA
ttgaaccacctcgt

SEQ ID NO: 5513 - DNA, 14 bp, synthetic construct
  source 1..14: mol_type = other DNA
tataaccgtagtga

SEQ ID NO: 5514 - DNA, 14 bp, synthetic construct
  source 1..14: mol_type = other DNA
cttgtactaggagc

SEQ ID NO: 5515 - DNA, 14 bp, synthetic construct
  source 1..14: mol_type = other DNA
tctgcgcgttagcg

SEQ ID NO: 5516 - DNA, 14 bp, synthetic construct
  source 1..14: mol_type = other DNA
ctcgagtgcatatg

SEQ ID NO: 5517 - DNA, 14 bp, synthetic construct
  source 1..14: mol_type = other DNA
ctattgcatcgaaa

SEQ ID NO: 5518 - DNA, 14 bp, synthetic construct
  source 1..14: mol_type = other DNA
ggtggttagtaaga

SEQ ID NO: 5519 - DNA, 14 bp, synthetic construct
  source 1..14: mol_type = other DNA
actacagtgttaca

SEQ ID NO: 5520 - DNA, 14 bp, synthetic construct
  source 1..14: mol_type = other DNA
gcatcacaattact

SEQ ID NO: 5521 - DNA, 14 bp, synthetic construct
  source 1..14: mol_type = other DNA
gggtgtgacagttg

SEQ ID NO: 5522 - DNA, 14 bp, synthetic construct
  source 1..14: mol_type = other DNA
ttagccgtgccgta

SEQ ID NO: 5523 - DNA, 14 bp, synthetic construct
  source 1..14: mol_type = other DNA
acatggaacatctt

SEQ ID NO: 5524 - DNA, 14 bp, synthetic construct
  source 1..14: mol_type = other DNA
ctgggactatgctc

SEQ ID NO: 5525 - DNA, 14 bp, synthetic construct
  source 1..14: mol_type = other DNA
tgtcacggtaccgt

SEQ ID NO: 5526 - DNA, 14 bp, synthetic construct
  source 1..14: mol_type = other DNA
atactctcggtccc

SEQ ID NO: 5527 - DNA, 14 bp, synthetic construct
  source 1..14: mol_type = other DNA
tatcaactaagact

SEQ ID NO: 5528 - DNA, 14 bp, synthetic construct
  source 1..14: mol_type = other DNA
attgggggatgagt

SEQ ID NO: 5529 - DNA, 14 bp, synthetic construct
  source 1..14: mol_type = other DNA
ctcaatgctagtgg

SEQ ID NO: 5530 - DNA, 14 bp, synthetic construct
  source 1..14: mol_type = other DNA
ttggctccgagtac

SEQ ID NO: 5531 - DNA, 14 bp, synthetic construct
  source 1..14: mol_type = other DNA
atggaatagagtat

SEQ ID NO: 5532 - DNA, 14 bp, synthetic construct
  source 1..14: mol_type = other DNA
cactgaatggtctg

SEQ ID NO: 5533 - DNA, 14 bp, synthetic construct
  source 1..14: mol_type = other DNA
tggaacgctcatat

SEQ ID NO: 5534 - DNA, 14 bp, synthetic construct
  source 1..14: mol_type = other DNA
attcacgagagtct

SEQ ID NO: 5535 - DNA, 14 bp, synthetic construct
  source 1..14: mol_type = other DNA
atgggatgctgcgt

SEQ ID NO: 5536 - DNA, 14 bp, synthetic construct
  source 1..14: mol_type = other DNA
acatgaagcttatc

SEQ ID NO: 5537 - DNA, 14 bp, synthetic construct
  source 1..14: mol_type = other DNA
cgactgttccataa

SEQ ID NO: 5538 - DNA, 14 bp, synthetic construct
  source 1..14: mol_type = other DNA
ctggagataactct

SEQ ID NO: 5539 - DNA, 14 bp, synthetic construct
  source 1..14: mol_type = other DNA
tgtgcagaataagt

SEQ ID NO: 5540 - DNA, 14 bp, synthetic construct
  source 1..14: mol_type = other DNA
atcgcgttccgtca

SEQ ID NO: 5541 - DNA, 14 bp, synthetic construct
  source 1..14: mol_type = other DNA
cacgggttgctata

SEQ ID NO: 5542 - DNA, 14 bp, synthetic construct
  source 1..14: mol_type = other DNA
caatctaccttaag

SEQ ID NO: 5543 - DNA, 14 bp, synthetic construct
  source 1..14: mol_type = other DNA
gctccattctgacg

SEQ ID NO: 5544 - DNA, 14 bp, synthetic construct
  source 1..14: mol_type = other DNA
ggttgcagacttgc

SEQ ID NO: 5545 - DNA, 14 bp, synthetic construct
  source 1..14: mol_type = other DNA
ccaagtttataagg

SEQ ID NO: 5546 - DNA, 14 bp, synthetic construct
  source 1..14: mol_type = other DNA
ggttcatgctacgc

SEQ ID NO: 5547 - DNA, 14 bp, synthetic construct
  source 1..14: mol_type = other DNA
cttgataccaatgg

SEQ ID NO: 5548 - DNA, 14 bp, synthetic construct
  source 1..14: mol_type = other DNA
gcttactgcgcatg

SEQ ID NO: 5549 - DNA, 14 bp, synthetic construct
  source 1..14: mol_type = other DNA
atgatctgtggcca

SEQ ID NO: 5550 - DNA, 14 bp, synthetic construct
  source 1..14: mol_type = other DNA
gggcttgtggtgcg

SEQ ID NO: 5551 - DNA, 14 bp, synthetic construct
  source 1..14: mol_type = other DNA
ccagtactcatgta

SEQ ID NO: 5552 - DNA, 14 bp, synthetic construct
  source 1..14: mol_type = other DNA
gtggaaaatggttg

SEQ ID NO: 5553 - DNA, 14 bp, synthetic construct
  source 1..14: mol_type = other DNA
gtcaagcatgcgtt

SEQ ID NO: 5554 - DNA, 14 bp, synthetic construct
  source 1..14: mol_type = other DNA
tccaaattaactac

SEQ ID NO: 5555 - DNA, 14 bp, synthetic construct
  source 1..14: mol_type = other DNA
tcgaattatcgcag

SEQ ID NO: 5556 - DNA, 14 bp, synthetic construct
  source 1..14: mol_type = other DNA
tctcgctacggcct

SEQ ID NO: 5557 - DNA, 14 bp, synthetic construct
  source 1..14: mol_type = other DNA
tggtgtgcaggtaa

SEQ ID NO: 5558 - DNA, 14 bp, synthetic construct
  source 1..14: mol_type = other DNA
atctcataatcaaa

SEQ ID NO: 5559 - DNA, 14 bp, synthetic construct
  source 1..14: mol_type = other DNA
tgctaaactagata

SEQ ID NO: 5560 - DNA, 14 bp, synthetic construct
  source 1..14: mol_type = other DNA
actcagaatgtctg

SEQ ID NO: 5561 - DNA, 14 bp, synthetic construct
  source 1..14: mol_type = other DNA
tggtcggcgtactc

SEQ ID NO: 5562 - DNA, 14 bp, synthetic construct
  source 1..14: mol_type = other DNA
cgcacttttacccg

SEQ ID NO: 5563 - DNA, 14 bp, synthetic construct
  source 1..14: mol_type = other DNA
tccattaaggatcc

SEQ ID NO: 5564 - DNA, 14 bp, synthetic construct
  source 1..14: mol_type = other DNA
cgcattgttgcgag

SEQ ID NO: 5565 - DNA, 14 bp, synthetic construct
  source 1..14: mol_type = other DNA
ataattagaggatc

SEQ ID NO: 5566 - DNA, 14 bp, synthetic construct
  source 1..14: mol_type = other DNA
aagttatccgccta

SEQ ID NO: 5567 - DNA, 14 bp, synthetic construct
  source 1..14: mol_type = other DNA
tataatctgccccc

SEQ ID NO: 5568 - DNA, 14 bp, synthetic construct
  source 1..14: mol_type = other DNA
ttggcatcaaaggt

SEQ ID NO: 5569 - DNA, 14 bp, synthetic construct
  source 1..14: mol_type = other DNA
gttcataacaatac

SEQ ID NO: 5570 - DNA, 14 bp, synthetic construct
  source 1..14: mol_type = other DNA
ccggacgaatgttt

SEQ ID NO: 5571 - DNA, 14 bp, synthetic construct
  source 1..14: mol_type = other DNA
ccactacacgttgt

SEQ ID NO: 5572 - DNA, 14 bp, synthetic construct
  source 1..14: mol_type = other DNA
gtgcggagcggttt

SEQ ID NO: 5573 - DNA, 14 bp, synthetic construct
  source 1..14: mol_type = other DNA
ctcataaagccttc

SEQ ID NO: 5574 - DNA, 14 bp, synthetic construct
  source 1..14: mol_type = other DNA
tagtctatcaggga

SEQ ID NO: 5575 - DNA, 14 bp, synthetic construct
  source 1..14: mol_type = other DNA
ctacactaccattc

SEQ ID NO: 5576 - DNA, 14 bp, synthetic construct
  source 1..14: mol_type = other DNA
tgccacggtcagtt

SEQ ID NO: 5577 - DNA, 14 bp, synthetic construct
  source 1..14: mol_type = other DNA
tttagaactcggcg

SEQ ID NO: 5578 - DNA, 14 bp, synthetic construct
  source 1..14: mol_type = other DNA
tcagaattgctaag

SEQ ID NO: 5579 - DNA, 14 bp, synthetic construct
  source 1..14: mol_type = other DNA
ttaaatatgcacag

SEQ ID NO: 5580 - DNA, 14 bp, synthetic construct
  source 1..14: mol_type = other DNA
tattccacgatgga

SEQ ID NO: 5581 - DNA, 14 bp, synthetic construct
  source 1..14: mol_type = other DNA
attggcgcatatag

SEQ ID NO: 5582 - DNA, 14 bp, synthetic construct
  source 1..14: mol_type = other DNA
ttaataaagtcgag

SEQ ID NO: 5583 - DNA, 14 bp, synthetic construct
  source 1..14: mol_type = other DNA
tctcaaaacacctt

SEQ ID NO: 5584 - DNA, 14 bp, synthetic construct
  source 1..14: mol_type = other DNA
gattggcataaagt

SEQ ID NO: 5585 - DNA, 14 bp, synthetic construct
  source 1..14: mol_type = other DNA
atggtggatagact

SEQ ID NO: 5586 - DNA, 14 bp, synthetic construct
  source 1..14: mol_type = other DNA
tgcgtcgcatgtgg

SEQ ID NO: 5587 - DNA, 14 bp, synthetic construct
  source 1..14: mol_type = other DNA
agctccgtcctatg

SEQ ID NO: 5588 - DNA, 14 bp, synthetic construct
  source 1..14: mol_type = other DNA
atgtaagagacctt

SEQ ID NO: 5589 - DNA, 14 bp, synthetic construct
  source 1..14: mol_type = other DNA
cgagcatcctctct

SEQ ID NO: 5590 - DNA, 14 bp, synthetic construct
  source 1..14: mol_type = other DNA
cgaccgtctttccg

SEQ ID NO: 5591 - DNA, 14 bp, synthetic construct
  source 1..14: mol_type = other DNA
cttagtccctacca

SEQ ID NO: 5592 - DNA, 14 bp, synthetic construct
  source 1..14: mol_type = other DNA
ctcagagtagggtt

SEQ ID NO: 5593 - DNA, 14 bp, synthetic construct
  source 1..14: mol_type = other DNA
tagccacttccgct

SEQ ID NO: 5594 - DNA, 14 bp, synthetic construct
  source 1..14: mol_type = other DNA
gtatcttcggacaa

SEQ ID NO: 5595 - DNA, 14 bp, synthetic construct
  source 1..14: mol_type = other DNA
gaccgttcataatc

SEQ ID NO: 5596 - DNA, 14 bp, synthetic construct
  source 1..14: mol_type = other DNA
tgataggagtgcgt

SEQ ID NO: 5597 - DNA, 14 bp, synthetic construct
  source 1..14: mol_type = other DNA
agtcctgtgctaac

SEQ ID NO: 5598 - DNA, 14 bp, synthetic construct
  source 1..14: mol_type = other DNA
gtccgtagttgagc

SEQ ID NO: 5599 - DNA, 14 bp, synthetic construct
  source 1..14: mol_type = other DNA
ggtgacgtcactgt

SEQ ID NO: 5600 - DNA, 14 bp, synthetic construct
  source 1..14: mol_type = other DNA
ttgtatcgggccgg

SEQ ID NO: 5601 - DNA, 14 bp, synthetic construct
  source 1..14: mol_type = other DNA
atatgaaggtaggt

SEQ ID NO: 5602 - DNA, 14 bp, synthetic construct
  source 1..14: mol_type = other DNA
tagacctggcgttg

SEQ ID NO: 5603 - DNA, 14 bp, synthetic construct
  source 1..14: mol_type = other DNA
agatagaaccattt

SEQ ID NO: 5604 - DNA, 14 bp, synthetic construct
  source 1..14: mol_type = other DNA
ttgttggagcggcc

SEQ ID NO: 5605 - DNA, 14 bp, synthetic construct
  source 1..14: mol_type = other DNA
ttgcggtctcacga

SEQ ID NO: 5606 - DNA, 14 bp, synthetic construct
  source 1..14: mol_type = other DNA
ccaacacttttagc

SEQ ID NO: 5607 - DNA, 14 bp, synthetic construct
  source 1..14: mol_type = other DNA
ttccaccaaatgta

SEQ ID NO: 5608 - DNA, 14 bp, synthetic construct
  source 1..14: mol_type = other DNA
catatgactaccct

SEQ ID NO: 5609 - DNA, 14 bp, synthetic construct
  source 1..14: mol_type = other DNA
gcccgttcaagtgt

SEQ ID NO: 5610 - DNA, 14 bp, synthetic construct
  source 1..14: mol_type = other DNA
aagtgtagcttacg

SEQ ID NO: 5611 - DNA, 14 bp, synthetic construct
  source 1..14: mol_type = other DNA
cactcgtcctgcta

SEQ ID NO: 5612 - DNA, 14 bp, synthetic construct
  source 1..14: mol_type = other DNA
ataaccgttaaagt

SEQ ID NO: 5613 - DNA, 14 bp, synthetic construct
  source 1..14: mol_type = other DNA
tctctgaaggtccc

SEQ ID NO: 5614 - DNA, 14 bp, synthetic construct
  source 1..14: mol_type = other DNA
tcacagggctgttc

SEQ ID NO: 5615 - DNA, 14 bp, synthetic construct
  source 1..14: mol_type = other DNA
aagtataaccctgt

SEQ ID NO: 5616 - DNA, 14 bp, synthetic construct
  source 1..14: mol_type = other DNA
ccactctcctctaa

SEQ ID NO: 5617 - DNA, 14 bp, synthetic construct
  source 1..14: mol_type = other DNA
gtagcctttcacac

SEQ ID NO: 5618 - DNA, 14 bp, synthetic construct
  source 1..14: mol_type = other DNA
tgtctcgcgtacac

SEQ ID NO: 5619 - DNA, 14 bp, synthetic construct
  source 1..14: mol_type = other DNA
cgttgactccgagt

SEQ ID NO: 5620 - DNA, 14 bp, synthetic construct
  source 1..14: mol_type = other DNA
taactggtcgccta

SEQ ID NO: 5621 - DNA, 14 bp, synthetic construct
  source 1..14: mol_type = other DNA
aaatcggttatgga

SEQ ID NO: 5622 - DNA, 14 bp, synthetic construct
  source 1..14: mol_type = other DNA
atgtataccactcg

SEQ ID NO: 5623 - DNA, 14 bp, synthetic construct
  source 1..14: mol_type = other DNA
cttgtaagatgacg

SEQ ID NO: 5624 - DNA, 14 bp, synthetic construct
  source 1..14: mol_type = other DNA
gccacgttccgatt

SEQ ID NO: 5625 - DNA, 14 bp, synthetic construct
  source 1..14: mol_type = other DNA
ctatgcggtaaatg

SEQ ID NO: 5626 - DNA, 14 bp, synthetic construct
  source 1..14: mol_type = other DNA
atttaggtaagacg

SEQ ID NO: 5627 - DNA, 14 bp, synthetic construct
  source 1..14: mol_type = other DNA
atgacacttgaact

SEQ ID NO: 5628 - DNA, 14 bp, synthetic construct
  source 1..14: mol_type = other DNA
cgtttatgacgagg

SEQ ID NO: 5629 - DNA, 14 bp, synthetic construct
  source 1..14: mol_type = other DNA
ctgtactacaatag

SEQ ID NO: 5630 - DNA, 14 bp, synthetic construct
  source 1..14: mol_type = other DNA
ctatgaactaactc

SEQ ID NO: 5631 - DNA, 14 bp, synthetic construct
  source 1..14: mol_type = other DNA
cttgagatgtaagg

SEQ ID NO: 5632 - DNA, 14 bp, synthetic construct
  source 1..14: mol_type = other DNA
accccaaccttttc

SEQ ID NO: 5633 - DNA, 14 bp, synthetic construct
  source 1..14: mol_type = other DNA
gttccgagagattg

SEQ ID NO: 5634 - DNA, 14 bp, synthetic construct
  source 1..14: mol_type = other DNA
tccgaaatttcgcc

SEQ ID NO: 5635 - DNA, 14 bp, synthetic construct
  source 1..14: mol_type = other DNA
acggtaaataatct

SEQ ID NO: 5636 - DNA, 14 bp, synthetic construct
  source 1..14: mol_type = other DNA
tggtgagcgctaat

SEQ ID NO: 5637 - DNA, 14 bp, synthetic construct
  source 1..14: mol_type = other DNA
gtgagaccggtttc

SEQ ID NO: 5638 - DNA, 14 bp, synthetic construct
  source 1..14: mol_type = other DNA
gtactagggatatg

SEQ ID NO: 5639 - DNA, 14 bp, synthetic construct
  source 1..14: mol_type = other DNA
gatcgtctaccggt

SEQ ID NO: 5640 - DNA, 14 bp, synthetic construct
  source 1..14: mol_type = other DNA
attgaatgtgaggg

SEQ ID NO: 5641 - DNA, 14 bp, synthetic construct
  source 1..14: mol_type = other DNA
ttgcgagctctccc

SEQ ID NO: 5642 - DNA, 14 bp, synthetic construct
  source 1..14: mol_type = other DNA
atttgctccaagcc

SEQ ID NO: 5643 - DNA, 14 bp, synthetic construct
  source 1..14: mol_type = other DNA
cgcatctgatgatg

SEQ ID NO: 5644 - DNA, 14 bp, synthetic construct
  source 1..14: mol_type = other DNA
tcgggatcctgtca

SEQ ID NO: 5645 - DNA, 14 bp, synthetic construct
  source 1..14: mol_type = other DNA
cactaactcttaga

SEQ ID NO: 5646 - DNA, 14 bp, synthetic construct
  source 1..14: mol_type = other DNA
ggttgtgccatcgg

SEQ ID NO: 5647 - DNA, 14 bp, synthetic construct
  source 1..14: mol_type = other DNA
ccgccatatcgatt

SEQ ID NO: 5648 - DNA, 14 bp, synthetic construct
  source 1..14: mol_type = other DNA
agaccgttgatctg

SEQ ID NO: 5649 - DNA, 14 bp, synthetic construct
  source 1..14: mol_type = other DNA
cccctcctgtatgg

SEQ ID NO: 5650 - DNA, 14 bp, synthetic construct
  source 1..14: mol_type = other DNA
cccttcaggtgact

SEQ ID NO: 5651 - DNA, 14 bp, synthetic construct
  source 1..14: mol_type = other DNA
tgacatggccgtgt

SEQ ID NO: 5652 - DNA, 14 bp, synthetic construct
  source 1..14: mol_type = other DNA
gaatagtgttgacc

SEQ ID NO: 5653 - DNA, 14 bp, synthetic construct
  source 1..14: mol_type = other DNA
ccattgatggccta

SEQ ID NO: 5654 - DNA, 14 bp, synthetic construct
  source 1..14: mol_type = other DNA
tgaccgtattgcaa

SEQ ID NO: 5655 - DNA, 14 bp, synthetic construct
  source 1..14: mol_type = other DNA
gctcccccagtgtt

SEQ ID NO: 5656 - DNA, 14 bp, synthetic construct
  source 1..14: mol_type = other DNA
aggcatattgtcga

SEQ ID NO: 5657 - DNA, 14 bp, synthetic construct
  source 1..14: mol_type = other DNA
tacgaaagattgtc

SEQ ID NO: 5658 - DNA, 14 bp, synthetic construct
  source 1..14: mol_type = other DNA
gtctacacatgact

SEQ ID NO: 5659 - DNA, 14 bp, synthetic construct
  source 1..14: mol_type = other DNA
accctttaacgcgt

SEQ ID NO: 5660 - DNA, 14 bp, synthetic construct
  source 1..14: mol_type = other DNA
agccatcttgtacc

SEQ ID NO: 5661 - DNA, 14 bp, synthetic construct
  source 1..14: mol_type = other DNA
gcccattcatatcg

SEQ ID NO: 5662 - DNA, 14 bp, synthetic construct
  source 1..14: mol_type = other DNA
ctaccatgctgcct

SEQ ID NO: 5663 - DNA, 14 bp, synthetic construct
  source 1..14: mol_type = other DNA
tggcggaattgtca

SEQ ID NO: 5664 - DNA, 14 bp, synthetic construct
  source 1..14: mol_type = other DNA
aagttccttgaaag

SEQ ID NO: 5665 - DNA, 14 bp, synthetic construct
  source 1..14: mol_type = other DNA
acttcgctacactc

SEQ ID NO: 5666 - DNA, 14 bp, synthetic construct
  source 1..14: mol_type = other DNA
ctgttcatgagcaa

SEQ ID NO: 5667 - DNA, 14 bp, synthetic construct
  source 1..14: mol_type = other DNA
gcctactttaaggc

SEQ ID NO: 5668 - DNA, 14 bp, synthetic construct
  source 1..14: mol_type = other DNA
ctatggctccacgt

SEQ ID NO: 5669 - DNA, 14 bp, synthetic construct
  source 1..14: mol_type = other DNA
cggcctcaattcct

SEQ ID NO: 5670 - DNA, 14 bp, synthetic construct
  source 1..14: mol_type = other DNA
cactgaagcttcct

SEQ ID NO: 5671 - DNA, 14 bp, synthetic construct
  source 1..14: mol_type = other DNA
cgatctaagtgtgg

SEQ ID NO: 5672 - DNA, 14 bp, synthetic construct
  source 1..14: mol_type = other DNA
ctgtcaatgggctc

SEQ ID NO: 5673 - DNA, 14 bp, synthetic construct
  source 1..14: mol_type = other DNA
gcctcgttcctggg

SEQ ID NO: 5674 - DNA, 14 bp, synthetic construct
  source 1..14: mol_type = other DNA
caattccattatgc

SEQ ID NO: 5675 - DNA, 14 bp, synthetic construct
  source 1..14: mol_type = other DNA
tcatactgcttggg

SEQ ID NO: 5676 - DNA, 14 bp, synthetic construct
  source 1..14: mol_type = other DNA
gtttagttcccgaa

SEQ ID NO: 5677 - DNA, 14 bp, synthetic construct
  source 1..14: mol_type = other DNA
ttcggtggtaaatc

SEQ ID NO: 5678 - DNA, 14 bp, synthetic construct
  source 1..14: mol_type = other DNA
tcctccgctctgtg

SEQ ID NO: 5679 - DNA, 14 bp, synthetic construct
  source 1..14: mol_type = other DNA
tggcgtctgtcgct

SEQ ID NO: 5680 - DNA, 14 bp, synthetic construct
  source 1..14: mol_type = other DNA
tactaggttcaata

SEQ ID NO: 5681 - DNA, 14 bp, synthetic construct
  source 1..14: mol_type = other DNA
gtattagggagtct

SEQ ID NO: 5682 - DNA, 14 bp, synthetic construct
  source 1..14: mol_type = other DNA
cgaattttaaagat

SEQ ID NO: 5683 - DNA, 14 bp, synthetic construct
  source 1..14: mol_type = other DNA
atcccttgtaatcg

SEQ ID NO: 5684 - DNA, 14 bp, synthetic construct
  source 1..14: mol_type = other DNA
ctgtggcattagct

SEQ ID NO: 5685 - DNA, 14 bp, synthetic construct
  source 1..14: mol_type = other DNA
ttatggtaatggac

SEQ ID NO: 5686 - DNA, 14 bp, synthetic construct
  source 1..14: mol_type = other DNA
tcagtgttccccct

SEQ ID NO: 5687 - DNA, 14 bp, synthetic construct
  source 1..14: mol_type = other DNA
taatcgtgggtatg

SEQ ID NO: 5688 - DNA, 14 bp, synthetic construct
  source 1..14: mol_type = other DNA
attattcgtcacaa

SEQ ID NO: 5689 - DNA, 14 bp, synthetic construct
  source 1..14: mol_type = other DNA
tatcgtagctgcct

SEQ ID NO: 5690 - DNA, 14 bp, synthetic construct
  source 1..14: mol_type = other DNA
tccgatactctcct

SEQ ID NO: 5691 - DNA, 14 bp, synthetic construct
  source 1..14: mol_type = other DNA
cagaactttagtgt

SEQ ID NO: 5692 - DNA, 14 bp, synthetic construct
  source 1..14: mol_type = other DNA
gcggcaatttaatt

SEQ ID NO: 5693 - DNA, 14 bp, synthetic construct
  source 1..14: mol_type = other DNA
accgccatgttttg

SEQ ID NO: 5694 - DNA, 14 bp, synthetic construct
  source 1..14: mol_type = other DNA
gcttgtgaatcatc

SEQ ID NO: 5695 - DNA, 14 bp, synthetic construct
  source 1..14: mol_type = other DNA
tttgttaccggagc

SEQ ID NO: 5696 - DNA, 14 bp, synthetic construct
  source 1..14: mol_type = other DNA
gtattcgactagtc

SEQ ID NO: 5697 - DNA, 14 bp, synthetic construct
  source 1..14: mol_type = other DNA
ttgtaaaacatgtg

SEQ ID NO: 5698 - DNA, 14 bp, synthetic construct
  source 1..14: mol_type = other DNA
gtggacttctcatc

SEQ ID NO: 5699 - DNA, 14 bp, synthetic construct
  source 1..14: mol_type = other DNA
gtccgtggtgtcct

SEQ ID NO: 5700 - DNA, 14 bp, synthetic construct
  source 1..14: mol_type = other DNA
tctccgctttcccc

SEQ ID NO: 5701 - DNA, 14 bp, synthetic construct
  source 1..14: mol_type = other DNA
ttttagcgcgactc

SEQ ID NO: 5702 - DNA, 14 bp, synthetic construct
  source 1..14: mol_type = other DNA
tgtgcgatcaatct

SEQ ID NO: 5703 - DNA, 14 bp, synthetic construct
  source 1..14: mol_type = other DNA
tctgctcatataaa

SEQ ID NO: 5704 - DNA, 14 bp, synthetic construct
  source 1..14: mol_type = other DNA
gttagtatccctga

SEQ ID NO: 5705 - DNA, 14 bp, synthetic construct
  source 1..14: mol_type = other DNA
gattaattggagct

SEQ ID NO: 5706 - DNA, 14 bp, synthetic construct
  source 1..14: mol_type = other DNA
tacactctaatctc

SEQ ID NO: 5707 - DNA, 14 bp, synthetic construct
  source 1..14: mol_type = other DNA
ttcgggatggttcc

SEQ ID NO: 5708 - DNA, 14 bp, synthetic construct
  source 1..14: mol_type = other DNA
tagacaactttatc

SEQ ID NO: 5709 - DNA, 14 bp, synthetic construct
  source 1..14: mol_type = other DNA
tgactatcatacta

SEQ ID NO: 5710 - DNA, 14 bp, synthetic construct
  source 1..14: mol_type = other DNA
gtaatgcctgtctc

SEQ ID NO: 5711 - DNA, 14 bp, synthetic construct
  source 1..14: mol_type = other DNA
ctttagttgggcaa

SEQ ID NO: 5712 - DNA, 14 bp, synthetic construct
  source 1..14: mol_type = other DNA
taatgcgtatataa

SEQ ID NO: 5713 - DNA, 14 bp, synthetic construct
  source 1..14: mol_type = other DNA
gatgccaatatgtt

SEQ ID NO: 5714 - DNA, 14 bp, synthetic construct
  source 1..14: mol_type = other DNA
agtattcatgcctc

SEQ ID NO: 5715 - DNA, 14 bp, synthetic construct
  source 1..14: mol_type = other DNA
ccttctcgcctgtc

SEQ ID NO: 5716 - DNA, 14 bp, synthetic construct
  source 1..14: mol_type = other DNA
atatgagtggtagt

SEQ ID NO: 5717 - DNA, 14 bp, synthetic construct
  source 1..14: mol_type = other DNA
tgcactttatggcg

SEQ ID NO: 5718 - DNA, 14 bp, synthetic construct
  source 1..14: mol_type = other DNA
actatcatatgtgg

SEQ ID NO: 5719 - DNA, 14 bp, synthetic construct
  source 1..14: mol_type = other DNA
cttccttagcacta

SEQ ID NO: 5720 - DNA, 14 bp, synthetic construct
  source 1..14: mol_type = other DNA
tcaattatctaccc

SEQ ID NO: 5721 - DNA, 14 bp, synthetic construct
  source 1..14: mol_type = other DNA
agtcaataaagttt

SEQ ID NO: 5722 - DNA, 14 bp, synthetic construct
  source 1..14: mol_type = other DNA
tgtaacccgtatta

SEQ ID NO: 5723 - DNA, 14 bp, synthetic construct
  source 1..14: mol_type = other DNA
aagtctacgatttc

SEQ ID NO: 5724 - DNA, 14 bp, synthetic construct
  source 1..14: mol_type = other DNA
gcgtcctcctatct

SEQ ID NO: 5725 - DNA, 14 bp, synthetic construct
  source 1..14: mol_type = other DNA
ggcaggttatgtgt

SEQ ID NO: 5726 - DNA, 14 bp, synthetic construct
  source 1..14: mol_type = other DNA
gagtatcattatcc

SEQ ID NO: 5727 - DNA, 14 bp, synthetic construct
  source 1..14: mol_type = other DNA
tttagccagacgtt

SEQ ID NO: 5728 - DNA, 14 bp, synthetic construct
  source 1..14: mol_type = other DNA
cgcactttttaaga

SEQ ID NO: 5729 - DNA, 14 bp, synthetic construct
  source 1..14: mol_type = other DNA
ttaactggtgcgtc

SEQ ID NO: 5730 - DNA, 14 bp, synthetic construct
  source 1..14: mol_type = other DNA
cattactgtaatgg

SEQ ID NO: 5731 - DNA, 14 bp, synthetic construct
  source 1..14: mol_type = other DNA
aatatctggctatc

SEQ ID NO: 5732 - DNA, 14 bp, synthetic construct
  source 1..14: mol_type = other DNA
cttctagtggctgg

SEQ ID NO: 5733 - DNA, 14 bp, synthetic construct
  source 1..14: mol_type = other DNA
catgtcatgccgtt

SEQ ID NO: 5734 - DNA, 14 bp, synthetic construct
  source 1..14: mol_type = other DNA
cggttgggtttcca

SEQ ID NO: 5735 - DNA, 14 bp, synthetic construct
  source 1..14: mol_type = other DNA
ggtggccaatttat

SEQ ID NO: 5736 - DNA, 14 bp, synthetic construct
  source 1..14: mol_type = other DNA
tatcggtcgcgtct

SEQ ID NO: 5737 - DNA, 14 bp, synthetic construct
  source 1..14: mol_type = other DNA
gtcatgtcatgatc

SEQ ID NO: 5738 - DNA, 14 bp, synthetic construct
  source 1..14: mol_type = other DNA
ctgcgagtgcttat

SEQ ID NO: 5739 - DNA, 14 bp, synthetic construct
  source 1..14: mol_type = other DNA
tacatagtctcata

SEQ ID NO: 5740 - DNA, 14 bp, synthetic construct
  source 1..14: mol_type = other DNA
ggactcgtctctat

SEQ ID NO: 5741 - DNA, 14 bp, synthetic construct
  source 1..14: mol_type = other DNA
ggggtactgttcat

SEQ ID NO: 5742 - DNA, 14 bp, synthetic construct
  source 1..14: mol_type = other DNA
ctctgtgcccattg

SEQ ID NO: 5743 - DNA, 14 bp, synthetic construct
  source 1..14: mol_type = other DNA
acgtttgatatgag

SEQ ID NO: 5744 - DNA, 14 bp, synthetic construct
  source 1..14: mol_type = other DNA
catactatatacta

SEQ ID NO: 5745 - DNA, 14 bp, synthetic construct
  source 1..14: mol_type = other DNA
tttggcagttcaca

SEQ ID NO: 5746 - DNA, 14 bp, synthetic construct
  source 1..14: mol_type = other DNA
atcgtgttcgacat

SEQ ID NO: 5747 - DNA, 14 bp, synthetic construct
  source 1..14: mol_type = other DNA
aacgtgtctcgttc

SEQ ID NO: 5748 - DNA, 14 bp, synthetic construct
  source 1..14: mol_type = other DNA
ggacgtattgtata

SEQ ID NO: 5749 - DNA, 14 bp, synthetic construct
  source 1..14: mol_type = other DNA
caatagtattagta

SEQ ID NO: 5750 - DNA, 14 bp, synthetic construct
  source 1..14: mol_type = other DNA
tggtaccttggcta

SEQ ID NO: 5751 - DNA, 14 bp, synthetic construct
  source 1..14: mol_type = other DNA
tacgattttacgag

SEQ ID NO: 5752 - DNA, 14 bp, synthetic construct
  source 1..14: mol_type = other DNA
tttcactacacgat

SEQ ID NO: 5753 - DNA, 14 bp, synthetic construct
  source 1..14: mol_type = other DNA
agattcgcgttctc

SEQ ID NO: 5754 - DNA, 14 bp, synthetic construct
  source 1..14: mol_type = other DNA
gtatttgagtcacg

SEQ ID NO: 5755 - DNA, 14 bp, synthetic construct
  source 1..14: mol_type = other DNA
cagttattatcgac

SEQ ID NO: 5756 - DNA, 14 bp, synthetic construct
  source 1..14: mol_type = other DNA
attcggtcgactta

SEQ ID NO: 5757 - DNA, 14 bp, synthetic construct
  source 1..14: mol_type = other DNA
gcctttcctggcgt

SEQ ID NO: 5758 - DNA, 14 bp, synthetic construct
  source 1..14: mol_type = other DNA
gtatcatcagatct

SEQ ID NO: 5759 - DNA, 14 bp, synthetic construct
  source 1..14: mol_type = other DNA
tatcgttagaaaat

SEQ ID NO: 5760 - DNA, 14 bp, synthetic construct
  source 1..14: mol_type = other DNA
tcgcttctgcaact

SEQ ID NO: 5761 - DNA, 14 bp, synthetic construct
  source 1..14: mol_type = other DNA
tttatacagctagg

SEQ ID NO: 5762 - DNA, 14 bp, synthetic construct
  source 1..14: mol_type = other DNA
tgcaaattagattg

SEQ ID NO: 5763 - DNA, 14 bp, synthetic construct
  source 1..14: mol_type = other DNA
gcctctatattcca

SEQ ID NO: 5764 - DNA, 14 bp, synthetic construct
  source 1..14: mol_type = other DNA
aagttcatcctctc

SEQ ID NO: 5765 - DNA, 14 bp, synthetic construct
  source 1..14: mol_type = other DNA
ttgccaacctttgg

SEQ ID NO: 5766 - DNA, 14 bp, synthetic construct
  source 1..14: mol_type = other DNA
gttttccggacctg

SEQ ID NO: 5767 - DNA, 14 bp, synthetic construct
  source 1..14: mol_type = other DNA
tgaaaaattgtctc

SEQ ID NO: 5768 - DNA, 14 bp, synthetic construct
  source 1..14: mol_type = other DNA
agtacatcattatg

SEQ ID NO: 5769 - DNA, 14 bp, synthetic construct
  source 1..14: mol_type = other DNA
cgttatcaggtggt

SEQ ID NO: 5770 - DNA, 14 bp, synthetic construct
  source 1..14: mol_type = other DNA
tggttcatagtacg

SEQ ID NO: 5771 - DNA, 14 bp, synthetic construct
  source 1..14: mol_type = other DNA
cggggtttctacat

SEQ ID NO: 5772 - DNA, 14 bp, synthetic construct
  source 1..14: mol_type = other DNA
taccaaggtttaat

SEQ ID NO: 5773 - DNA, 14 bp, synthetic construct
  source 1..14: mol_type = other DNA
ccattacgtcctta

SEQ ID NO: 5774 - DNA, 14 bp, synthetic construct
  source 1..14: mol_type = other DNA
ctgaatgttaaata

SEQ ID NO: 5775 - DNA, 14 bp, synthetic construct
  source 1..14: mol_type = other DNA
ttgaattatgccca

SEQ ID NO: 5776 - DNA, 14 bp, synthetic construct
  source 1..14: mol_type = other DNA
tttaggctgcacct

SEQ ID NO: 5777 - DNA, 14 bp, synthetic construct
  source 1..14: mol_type = other DNA
tggtaaccctgtta

SEQ ID NO: 5778 - DNA, 14 bp, synthetic construct
  source 1..14: mol_type = other DNA
atctctatgagtgc

SEQ ID NO: 5779 - DNA, 14 bp, synthetic construct
  source 1..14: mol_type = other DNA
ccttcttgatcgag

SEQ ID NO: 5780 - DNA, 14 bp, synthetic construct
  source 1..14: mol_type = other DNA
gcagaatattattc

SEQ ID NO: 5781 - DNA, 14 bp, synthetic construct
  source 1..14: mol_type = other DNA
tggcagggatttct

SEQ ID NO: 5782 - DNA, 14 bp, synthetic construct
  source 1..14: mol_type = other DNA
gctcctgtgtccta

SEQ ID NO: 5783 - DNA, 14 bp, synthetic construct
  source 1..14: mol_type = other DNA
attcctgatggcct

SEQ ID NO: 5784 - DNA, 14 bp, synthetic construct
  source 1..14: mol_type = other DNA
accccttattgaat

SEQ ID NO: 5785 - DNA, 14 bp, synthetic construct
  source 1..14: mol_type = other DNA
tagacacgttttgg

SEQ ID NO: 5786 - DNA, 14 bp, synthetic construct
  source 1..14: mol_type = other DNA
gtaatgatacttca

SEQ ID NO: 5787 - DNA, 14 bp, synthetic construct
  source 1..14: mol_type = other DNA
cttacgtcctgtca

SEQ ID NO: 5788 - DNA, 14 bp, synthetic construct
  source 1..14: mol_type = other DNA
gcctgtggtgatta

SEQ ID NO: 5789 - DNA, 14 bp, synthetic construct
  source 1..14: mol_type = other DNA
tgtcatattgccag

SEQ ID NO: 5790 - DNA, 14 bp, synthetic construct
  source 1..14: mol_type = other DNA
tgttctatccaagc

SEQ ID NO: 5791 - DNA, 14 bp, synthetic construct
  source 1..14: mol_type = other DNA
tccccttatctaca

SEQ ID NO: 5792 - DNA, 14 bp, synthetic construct
  source 1..14: mol_type = other DNA
cttctaggaggttc

SEQ ID NO: 5793 - DNA, 14 bp, synthetic construct
  source 1..14: mol_type = other DNA
attcgcggtgggtt

SEQ ID NO: 5794 - DNA, 14 bp, synthetic construct
  source 1..14: mol_type = other DNA
tacatgtggcctta

SEQ ID NO: 5795 - DNA, 14 bp, synthetic construct
  source 1..14: mol_type = other DNA
tgacgtccctcttc

SEQ ID NO: 5796 - DNA, 14 bp, synthetic construct
  source 1..14: mol_type = other DNA
gtaaccttaacctt

SEQ ID NO: 5797 - DNA, 14 bp, synthetic construct
  source 1..14: mol_type = other DNA
actgatgtttcaac

SEQ ID NO: 5798 - DNA, 14 bp, synthetic construct
  source 1..14: mol_type = other DNA
cattttcaggagtc

SEQ ID NO: 5799 - DNA, 14 bp, synthetic construct
  source 1..14: mol_type = other DNA
atggtacgcatttc

SEQ ID NO: 5800 - DNA, 14 bp, synthetic construct
  source 1..14: mol_type = other DNA
ctcgatgtgcttca

SEQ ID NO: 5801 - DNA, 14 bp, synthetic construct
  source 1..14: mol_type = other DNA
cctctttacgcctc

SEQ ID NO: 5802 - DNA, 14 bp, synthetic construct
  source 1..14: mol_type = other DNA
gttgtgcctactcg

SEQ ID NO: 5803 - DNA, 14 bp, synthetic construct
  source 1..14: mol_type = other DNA
gtactcgtatatcg

SEQ ID NO: 5804 - DNA, 14 bp, synthetic construct
  source 1..14: mol_type = other DNA
gaatatctagttag

SEQ ID NO: 5805 - DNA, 14 bp, synthetic construct
  source 1..14: mol_type = other DNA
gggcactcgttgtt

SEQ ID NO: 5806 - DNA, 14 bp, synthetic construct
  source 1..14: mol_type = other DNA
gtttattggagggg

SEQ ID NO: 5807 - DNA, 14 bp, synthetic construct
  source 1..14: mol_type = other DNA
acctgttgacgttg

SEQ ID NO: 5808 - DNA, 14 bp, synthetic construct
  source 1..14: mol_type = other DNA
cctgattagttcac

SEQ ID NO: 5809 - DNA, 14 bp, synthetic construct
  source 1..14: mol_type = other DNA
agctctctctaagt

SEQ ID NO: 5810 - DNA, 14 bp, synthetic construct
  source 1..14: mol_type = other DNA
ctggttcaatgaat

SEQ ID NO: 5811 - DNA, 14 bp, synthetic construct
  source 1..14: mol_type = other DNA
ctacgtctatgtgc

SEQ ID NO: 5812 - DNA, 14 bp, synthetic construct
  source 1..14: mol_type = other DNA
ctctgggttagcta

SEQ ID NO: 5813 - DNA, 14 bp, synthetic construct
  source 1..14: mol_type = other DNA
tcgatagattccct

SEQ ID NO: 5814 - DNA, 14 bp, synthetic construct
  source 1..14: mol_type = other DNA
ctatcgttcagtgc

SEQ ID NO: 5815 - DNA, 14 bp, synthetic construct
  source 1..14: mol_type = other DNA
ggattgatgataat

SEQ ID NO: 5816 - DNA, 14 bp, synthetic construct
  source 1..14: mol_type = other DNA
tactggagatatct

SEQ ID NO: 5817 - DNA, 14 bp, synthetic construct
  source 1..14: mol_type = other DNA
ttagaccaatagtt

SEQ ID NO: 5818 - DNA, 14 bp, synthetic construct
  source 1..14: mol_type = other DNA
ttgttagctcaggc

SEQ ID NO: 5819 - DNA, 14 bp, synthetic construct
  source 1..14: mol_type = other DNA
ctttaatatcacac

SEQ ID NO: 5820 - DNA, 14 bp, synthetic construct
  source 1..14: mol_type = other DNA
tcagctcgtactta

SEQ ID NO: 5821 - DNA, 14 bp, synthetic construct
  source 1..14: mol_type = other DNA
ggtcttgcgtaata

SEQ ID NO: 5822 - DNA, 14 bp, synthetic construct
  source 1..14: mol_type = other DNA
acagggatattttc

SEQ ID NO: 5823 - DNA, 14 bp, synthetic construct
  source 1..14: mol_type = other DNA
ttgatgcgtagtgg

SEQ ID NO: 5824 - DNA, 14 bp, synthetic construct
  source 1..14: mol_type = other DNA
gctttaacagtcta

SEQ ID NO: 5825 - DNA, 14 bp, synthetic construct
  source 1..14: mol_type = other DNA
ggctatacctcctt

SEQ ID NO: 5826 - DNA, 14 bp, synthetic construct
  source 1..14: mol_type = other DNA
cattgtcctccgtc

SEQ ID NO: 5827 - DNA, 14 bp, synthetic construct
  source 1..14: mol_type = other DNA
ccttacgtgcttag

SEQ ID NO: 5828 - DNA, 14 bp, synthetic construct
  source 1..14: mol_type = other DNA
gctttaaattcccc

SEQ ID NO: 5829 - DNA, 14 bp, synthetic construct
  source 1..14: mol_type = other DNA
cctatgtcttgacg

SEQ ID NO: 5830 - DNA, 14 bp, synthetic construct
  source 1..14: mol_type = other DNA
gcttttgggccctc

SEQ ID NO: 5831 - DNA, 14 bp, synthetic construct
  source 1..14: mol_type = other DNA
gtgagctgtatcta

SEQ ID NO: 5832 - DNA, 14 bp, synthetic construct
  source 1..14: mol_type = other DNA
tatggatgtatgca

SEQ ID NO: 5833 - DNA, 14 bp, synthetic construct
  source 1..14: mol_type = other DNA
gatcttcccgtgta

SEQ ID NO: 5834 - DNA, 14 bp, synthetic construct
  source 1..14: mol_type = other DNA
cgttctatggtcgc

SEQ ID NO: 5835 - DNA, 14 bp, synthetic construct
  source 1..14: mol_type = other DNA
tgttggttgcggcc

SEQ ID NO: 5836 - DNA, 14 bp, synthetic construct
  source 1..14: mol_type = other DNA
agtgtagagttcgt

SEQ ID NO: 5837 - DNA, 14 bp, synthetic construct
  source 1..14: mol_type = other DNA
ttcagaagtaactt

SEQ ID NO: 5838 - DNA, 14 bp, synthetic construct
  source 1..14: mol_type = other DNA
acgggtttgtactc

SEQ ID NO: 5839 - DNA, 14 bp, synthetic construct
  source 1..14: mol_type = other DNA
tgaggttctctaac

SEQ ID NO: 5840 - DNA, 14 bp, synthetic construct
  source 1..14: mol_type = other DNA
ctcctccgggtctt

SEQ ID NO: 5841 - DNA, 14 bp, synthetic construct
  source 1..14: mol_type = other DNA
attttcaggtaagg

SEQ ID NO: 5842 - DNA, 14 bp, synthetic construct
  source 1..14: mol_type = other DNA
ccccctatatcctt

SEQ ID NO: 5843 - DNA, 14 bp, synthetic construct
  source 1..14: mol_type = other DNA
tgcgtgtgcgattc

SEQ ID NO: 5844 - DNA, 14 bp, synthetic construct
  source 1..14: mol_type = other DNA
taatgcgtctgctc

SEQ ID NO: 5845 - DNA, 14 bp, synthetic construct
  source 1..14: mol_type = other DNA
cctatcccatatgt

SEQ ID NO: 5846 - DNA, 14 bp, synthetic construct
  source 1..14: mol_type = other DNA
tcaccattatcgta

SEQ ID NO: 5847 - DNA, 14 bp, synthetic construct
  source 1..14: mol_type = other DNA
taggaagttgatta

SEQ ID NO: 5848 - DNA, 14 bp, synthetic construct
  source 1..14: mol_type = other DNA
ttggcaggttacta

SEQ ID NO: 5849 - DNA, 14 bp, synthetic construct
  source 1..14: mol_type = other DNA
attcattgctgggc

SEQ ID NO: 5850 - DNA, 14 bp, synthetic construct
  source 1..14: mol_type = other DNA
tcggatcgttatga

SEQ ID NO: 5851 - DNA, 14 bp, synthetic construct
  source 1..14: mol_type = other DNA
ttatgcgctaacgt

SEQ ID NO: 5852 - DNA, 14 bp, synthetic construct
  source 1..14: mol_type = other DNA
tgtgttgaacgcgt

SEQ ID NO: 5853 - DNA, 14 bp, synthetic construct
  source 1..14: mol_type = other DNA
aggcttatctgctg

SEQ ID NO: 5854 - DNA, 14 bp, synthetic construct
  source 1..14: mol_type = other DNA
cgttccctagtgtc

SEQ ID NO: 5855 - DNA, 14 bp, synthetic construct
  source 1..14: mol_type = other DNA
tgtggttataccac

SEQ ID NO: 5856 - DNA, 14 bp, synthetic construct
  source 1..14: mol_type = other DNA
gccctctcatcttc

SEQ ID NO: 5857 - DNA, 14 bp, synthetic construct
  source 1..14: mol_type = other DNA
ctgttaaatagtgc

SEQ ID NO: 5858 - DNA, 14 bp, synthetic construct
  source 1..14: mol_type = other DNA
cgtcgtagttagta

SEQ ID NO: 5859 - DNA, 14 bp, synthetic construct
  source 1..14: mol_type = other DNA
tgttgactaccctg

SEQ ID NO: 5860 - DNA, 14 bp, synthetic construct
  source 1..14: mol_type = other DNA
cctagcttctctcc

SEQ ID NO: 5861 - DNA, 14 bp, synthetic construct
  source 1..14: mol_type = other DNA
caatttgattcgac

SEQ ID NO: 5862 - DNA, 14 bp, synthetic construct
  source 1..14: mol_type = other DNA
tgtgtgtatgagaa

SEQ ID NO: 5863 - DNA, 14 bp, synthetic construct
  source 1..14: mol_type = other DNA
atctgtcctgccta

SEQ ID NO: 5864 - DNA, 14 bp, synthetic construct
  source 1..14: mol_type = other DNA
tagaggtttgtcac

SEQ ID NO: 5865 - DNA, 14 bp, synthetic construct
  source 1..14: mol_type = other DNA
atatgcgggtttcc

SEQ ID NO: 5866 - DNA, 14 bp, synthetic construct
  source 1..14: mol_type = other DNA
caatattgcaatat

SEQ ID NO: 5867 - DNA, 14 bp, synthetic construct
  source 1..14: mol_type = other DNA
gacacttactttca

SEQ ID NO: 5868 - DNA, 14 bp, synthetic construct
  source 1..14: mol_type = other DNA
catcttaccattgc

SEQ ID NO: 5869 - DNA, 14 bp, synthetic construct
  source 1..14: mol_type = other DNA
gagtttgaattcag

SEQ ID NO: 5870 - DNA, 14 bp, synthetic construct
  source 1..14: mol_type = other DNA
ttcagatcgtcgta

SEQ ID NO: 5871 - DNA, 14 bp, synthetic construct
  source 1..14: mol_type = other DNA
agcgccttctgttc

SEQ ID NO: 5872 - DNA, 14 bp, synthetic construct
  source 1..14: mol_type = other DNA
acggtcttgactgt

SEQ ID NO: 5873 - DNA, 14 bp, synthetic construct
  source 1..14: mol_type = other DNA
ggaagtctcgttgt

SEQ ID NO: 5874 - DNA, 14 bp, synthetic construct
  source 1..14: mol_type = other DNA
ctgataggttcata

SEQ ID NO: 5875 - DNA, 14 bp, synthetic construct
  source 1..14: mol_type = other DNA
catcgtattgtagc

SEQ ID NO: 5876 - DNA, 14 bp, synthetic construct
  source 1..14: mol_type = other DNA
actgccttcggtgt

SEQ ID NO: 5877 - DNA, 14 bp, synthetic construct
  source 1..14: mol_type = other DNA
ccattaagttatac

SEQ ID NO: 5878 - DNA, 14 bp, synthetic construct
  source 1..14: mol_type = other DNA
gtgttcggcctctg

SEQ ID NO: 5879 - DNA, 14 bp, synthetic construct
  source 1..14: mol_type = other DNA
ttgctgttacgcgg

SEQ ID NO: 5880 - DNA, 14 bp, synthetic construct
  source 1..14: mol_type = other DNA
gtttcgtgtacagc

SEQ ID NO: 5881 - DNA, 14 bp, synthetic construct
  source 1..14: mol_type = other DNA
gttcgctccctact

SEQ ID NO: 5882 - DNA, 14 bp, synthetic construct
  source 1..14: mol_type = other DNA
aacatgttagattc

SEQ ID NO: 5883 - DNA, 14 bp, synthetic construct
  source 1..14: mol_type = other DNA
ctcaccattatatg

SEQ ID NO: 5884 - DNA, 14 bp, synthetic construct
  source 1..14: mol_type = other DNA
ttggattctaaacg

SEQ ID NO: 5885 - DNA, 14 bp, synthetic construct
  source 1..14: mol_type = other DNA
tgaattgagtcggt

SEQ ID NO: 5886 - DNA, 14 bp, synthetic construct
  source 1..14: mol_type = other DNA
cactctcttgaggt

SEQ ID NO: 5887 - DNA, 14 bp, synthetic construct
  source 1..14: mol_type = other DNA
tcgttctatgcggg

SEQ ID NO: 5888 - DNA, 14 bp, synthetic construct
  source 1..14: mol_type = other DNA
gcttccattcacct

SEQ ID NO: 5889 - DNA, 14 bp, synthetic construct
  source 1..14: mol_type = other DNA
tgttactcgcccat

SEQ ID NO: 5890 - DNA, 14 bp, synthetic construct
  source 1..14: mol_type = other DNA
tgatcatatggcct

SEQ ID NO: 5891 - DNA, 14 bp, synthetic construct
  source 1..14: mol_type = other DNA
agttcgtcctacat

SEQ ID NO: 5892 - DNA, 14 bp, synthetic construct
  source 1..14: mol_type = other DNA
gtagaagtttatag

SEQ ID NO: 5893 - DNA, 14 bp, synthetic construct
  source 1..14: mol_type = other DNA
ttggtactagaaat

SEQ ID NO: 5894 - DNA, 14 bp, synthetic construct
  source 1..14: mol_type = other DNA
tagttcataatggc

SEQ ID NO: 5895 - DNA, 14 bp, synthetic construct
  source 1..14: mol_type = other DNA
tagctgatctgtcc

SEQ ID NO: 5896 - DNA, 14 bp, synthetic construct
  source 1..14: mol_type = other DNA
cagtgtcggccttt

SEQ ID NO: 5897 - DNA, 14 bp, synthetic construct
  source 1..14: mol_type = other DNA
tcttgggcacggtt

SEQ ID NO: 5898 - DNA, 14 bp, synthetic construct
  source 1..14: mol_type = other DNA
agacttgcttactg

SEQ ID NO: 5899 - DNA, 14 bp, synthetic construct
  source 1..14: mol_type = other DNA
ggtatgaaaacttt

SEQ ID NO: 5900 - DNA, 14 bp, synthetic construct
  source 1..14: mol_type = other DNA
gtcttgaccgtaat

SEQ ID NO: 5901 - DNA, 14 bp, synthetic construct
  source 1..14: mol_type = other DNA
aatcttgatgacta

SEQ ID NO: 5902 - DNA, 14 bp, synthetic construct
  source 1..14: mol_type = other DNA
atcgcagtttatcc

SEQ ID NO: 5903 - DNA, 14 bp, synthetic construct
  source 1..14: mol_type = other DNA
ccatattgaattcg

SEQ ID NO: 5904 - DNA, 14 bp, synthetic construct
  source 1..14: mol_type = other DNA
tgcttatacatcaa

SEQ ID NO: 5905 - DNA, 14 bp, synthetic construct
  source 1..14: mol_type = other DNA
catgtgactttcag

SEQ ID NO: 5906 - DNA, 14 bp, synthetic construct
  source 1..14: mol_type = other DNA
attgagaagtcatt

SEQ ID NO: 5907 - DNA, 14 bp, synthetic construct
  source 1..14: mol_type = other DNA
aatccggatttgct

SEQ ID NO: 5908 - DNA, 14 bp, synthetic construct
  source 1..14: mol_type = other DNA
tctgtcctgacgtg

SEQ ID NO: 5909 - DNA, 14 bp, synthetic construct
  source 1..14: mol_type = other DNA
atgtgcaattgagt

SEQ ID NO: 5910 - DNA, 14 bp, synthetic construct
  source 1..14: mol_type = other DNA
aagatgtgccgttt

SEQ ID NO: 5911 - DNA, 14 bp, synthetic construct
  source 1..14: mol_type = other DNA
agagttgcttctac

SEQ ID NO: 5912 - DNA, 14 bp, synthetic construct
  source 1..14: mol_type = other DNA
atgcttatatccac

SEQ ID NO: 5913 - DNA, 14 bp, synthetic construct
  source 1..14: mol_type = other DNA
atcatactagtatc

SEQ ID NO: 5914 - DNA, 14 bp, synthetic construct
  source 1..14: mol_type = other DNA
ggttctgaggttac

SEQ ID NO: 5915 - DNA, 14 bp, synthetic construct
  source 1..14: mol_type = other DNA
gtgtaattcgccat

SEQ ID NO: 5916 - DNA, 14 bp, synthetic construct
  source 1..14: mol_type = other DNA
cgttcagaggcttt

SEQ ID NO: 5917 - DNA, 14 bp, synthetic construct
  source 1..14: mol_type = other DNA
tcgtactataaagt

SEQ ID NO: 5918 - DNA, 14 bp, synthetic construct
  source 1..14: mol_type = other DNA
tttgcatcctagaa

SEQ ID NO: 5919 - DNA, 14 bp, synthetic construct
  source 1..14: mol_type = other DNA
cggtttacgttaga

SEQ ID NO: 5920 - DNA, 14 bp, synthetic construct
  source 1..14: mol_type = other DNA
tccgtaagattcat

SEQ ID NO: 5921 - DNA, 14 bp, synthetic construct
  source 1..14: mol_type = other DNA
gcgatactttctcc

SEQ ID NO: 5922 - DNA, 14 bp, synthetic construct
  source 1..14: mol_type = other DNA
caaacttggtttac

SEQ ID NO: 5923 - DNA, 14 bp, synthetic construct
  source 1..14: mol_type = other DNA
tgttgcagattgca

SEQ ID NO: 5924 - DNA, 14 bp, synthetic construct
  source 1..14: mol_type = other DNA
cggtttgatctcgc

SEQ ID NO: 5925 - DNA, 14 bp, synthetic construct
  source 1..14: mol_type = other DNA
aactcgtaggattt

SEQ ID NO: 5926 - DNA, 14 bp, synthetic construct
  source 1..14: mol_type = other DNA
aattgctctaggtg

SEQ ID NO: 5927 - DNA, 14 bp, synthetic construct
  source 1..14: mol_type = other DNA
tcatcatttggaag

SEQ ID NO: 5928 - DNA, 14 bp, synthetic construct
  source 1..14: mol_type = other DNA
ttgcgcttatccca

SEQ ID NO: 5929 - DNA, 14 bp, synthetic construct
  source 1..14: mol_type = other DNA
aatgtattctgaag

SEQ ID NO: 5930 - DNA, 14 bp, synthetic construct
  source 1..14: mol_type = other DNA
acaattcttcttgc

SEQ ID NO: 5931 - DNA, 14 bp, synthetic construct
  source 1..14: mol_type = other DNA
agctgaatatttta

SEQ ID NO: 5932 - DNA, 14 bp, synthetic construct
  source 1..14: mol_type = other DNA
ctatgtttctccag

SEQ ID NO: 5933 - DNA, 14 bp, synthetic construct
  source 1..14: mol_type = other DNA
gcctttctctctaa

SEQ ID NO: 5934 - DNA, 14 bp, synthetic construct
  source 1..14: mol_type = other DNA
tctctttcgactaa

SEQ ID NO: 5935 - DNA, 14 bp, synthetic construct
  source 1..14: mol_type = other DNA
gatttatcgctctg

SEQ ID NO: 5936 - DNA, 14 bp, synthetic construct
  source 1..14: mol_type = other DNA
tatcttaatgctgc

SEQ ID NO: 5937 - DNA, 14 bp, synthetic construct
  source 1..14: mol_type = other DNA
ggtacttggtcttg

SEQ ID NO: 5938 - DNA, 14 bp, synthetic construct
  source 1..14: mol_type = other DNA
tatctgtacagtgt

SEQ ID NO: 5939 - DNA, 14 bp, synthetic construct
  source 1..14: mol_type = other DNA
tagtttgaactgct

SEQ ID NO: 5940 - DNA, 14 bp, synthetic construct
  source 1..14: mol_type = other DNA
ttaaccttgttcga

SEQ ID NO: 5941 - DNA, 14 bp, synthetic construct
  source 1..14: mol_type = other DNA
cactgtacttgctt

SEQ ID NO: 5942 - DNA, 14 bp, synthetic construct
  source 1..14: mol_type = other DNA
cgtgtataatttgg

SEQ ID NO: 5943 - DNA, 14 bp, synthetic construct
  source 1..14: mol_type = other DNA
atgtaactctttcc

SEQ ID NO: 5944 - DNA, 14 bp, synthetic construct
  source 1..14: mol_type = other DNA
atggtctgtcatgt

SEQ ID NO: 5945 - DNA, 14 bp, synthetic construct
  source 1..14: mol_type = other DNA
gttaggttgatgat

SEQ ID NO: 5946 - DNA, 14 bp, synthetic construct
  source 1..14: mol_type = other DNA
tagtttagttcggg

SEQ ID NO: 5947 - DNA, 14 bp, synthetic construct
  source 1..14: mol_type = other DNA
tgtgttacaactat

SEQ ID NO: 5948 - DNA, 14 bp, synthetic construct
  source 1..14: mol_type = other DNA
tgtgaggatttatc

SEQ ID NO: 5949 - DNA, 14 bp, synthetic construct
  source 1..14: mol_type = other DNA
tttcgctaaaattc

SEQ ID NO: 5950 - DNA, 14 bp, synthetic construct
  source 1..14: mol_type = other DNA
cataagttgttgtg

SEQ ID NO: 5951 - DNA, 14 bp, synthetic construct
  source 1..14: mol_type = other DNA
cttattggcatatc

SEQ ID NO: 5952 - DNA, 14 bp, synthetic construct
  source 1..14: mol_type = other DNA
tcgtcttatggata

SEQ ID NO: 5953 - DNA, 14 bp, synthetic construct
  source 1..14: mol_type = other DNA
tagaagtactcttt

SEQ ID NO: 5954 - DNA, 14 bp, synthetic construct
  source 1..14: mol_type = other DNA
ctgtttccacatta

SEQ ID NO: 5955 - DNA, 14 bp, synthetic construct
  source 1..14: mol_type = other DNA
ttgatagactgttg

SEQ ID NO: 5956 - DNA, 14 bp, synthetic construct
  source 1..14: mol_type = other DNA
ctaatgttttggag

SEQ ID NO: 5957 - DNA, 14 bp, synthetic construct
  source 1..14: mol_type = other DNA
ctagctatttaatg

SEQ ID NO: 5958 - DNA, 14 bp, synthetic construct
  source 1..14: mol_type = other DNA
gggctttttaggtg

SEQ ID NO: 5959 - DNA, 14 bp, synthetic construct
  source 1..14: mol_type = other DNA
gggtttactgtctg

SEQ ID NO: 5960 - DNA, 14 bp, synthetic construct
  source 1..14: mol_type = other DNA
atctctcattctcc

SEQ ID NO: 5961 - DNA, 14 bp, synthetic construct
  source 1..14: mol_type = other DNA
tgtttacaccatgt

SEQ ID NO: 5962 - DNA, 14 bp, synthetic construct
  source 1..14: mol_type = other DNA
ctctcttaagcttc

SEQ ID NO: 5963 - DNA, 14 bp, synthetic construct
  source 1..14: mol_type = other DNA
cacgatgtttattg

SEQ ID NO: 5964 - DNA, 14 bp, synthetic construct
  source 1..14: mol_type = other DNA
tatctgcgtggtat

SEQ ID NO: 5965 - DNA, 14 bp, synthetic construct
  source 1..14: mol_type = other DNA
tttagtatcgaatg

SEQ ID NO: 5966 - DNA, 14 bp, synthetic construct
  source 1..14: mol_type = other DNA
tgatgatcactctt

SEQ ID NO: 5967 - DNA, 14 bp, synthetic construct
  source 1..14: mol_type = other DNA
tcttgaggtgcttc

SEQ ID NO: 5968 - DNA, 14 bp, synthetic construct
  source 1..14: mol_type = other DNA
aatttggcaattat

SEQ ID NO: 5969 - DNA, 14 bp, synthetic construct
  source 1..14: mol_type = other DNA
ggcttattcagctt

SEQ ID NO: 5970 - DNA, 14 bp, synthetic construct
  source 1..14: mol_type = other DNA
ggtatgctctgtat

SEQ ID NO: 5971 - DNA, 14 bp, synthetic construct
  source 1..14: mol_type = other DNA
tttaagggctttca

SEQ ID NO: 5972 - DNA, 14 bp, synthetic construct
  source 1..14: mol_type = other DNA
caacatggttgttt

SEQ ID NO: 5973 - DNA, 14 bp, synthetic construct
  source 1..14: mol_type = other DNA
tttatgtagagaat

SEQ ID NO: 5974 - DNA, 14 bp, synthetic construct
  source 1..14: mol_type = other DNA
gtgaatgttcatct

SEQ ID NO: 5975 - DNA, 14 bp, synthetic construct
  source 1..14: mol_type = other DNA
ttaagtccgtttcc

SEQ ID NO: 5976 - DNA, 14 bp, synthetic construct
  source 1..14: mol_type = other DNA
ttttgccgtgcagt

SEQ ID NO: 5977 - DNA, 14 bp, synthetic construct
  source 1..14: mol_type = other DNA
atttctgtccaata

SEQ ID NO: 5978 - DNA, 14 bp, synthetic construct
  source 1..14: mol_type = other DNA
tgaattttacgtgg

SEQ ID NO: 5979 - DNA, 14 bp, synthetic construct
  source 1..14: mol_type = other DNA
ggttaacttggatt

SEQ ID NO: 5980 - DNA, 14 bp, synthetic construct
  source 1..14: mol_type = other DNA
tccatatgttatgc

SEQ ID NO: 5981 - DNA, 14 bp, synthetic construct
  source 1..14: mol_type = other DNA
tacatatttctcaa

SEQ ID NO: 5982 - DNA, 14 bp, synthetic construct
  source 1..14: mol_type = other DNA
cttagggcatattt

SEQ ID NO: 5983 - DNA, 14 bp, synthetic construct
  source 1..14: mol_type = other DNA
cccattgtttccgt

SEQ ID NO: 5984 - DNA, 14 bp, synthetic construct
  source 1..14: mol_type = other DNA
ttgttggccttcga

SEQ ID NO: 5985 - DNA, 14 bp, synthetic construct
  source 1..14: mol_type = other DNA
tgtctgcacctctt

SEQ ID NO: 5986 - DNA, 14 bp, synthetic construct
  source 1..14: mol_type = other DNA
ttacttgtatagac

SEQ ID NO: 5987 - DNA, 14 bp, synthetic construct
  source 1..14: mol_type = other DNA
cctagaaatttatt

SEQ ID NO: 5988 - DNA, 14 bp, synthetic construct
  source 1..14: mol_type = other DNA
cttgatctattaag

SEQ ID NO: 5989 - DNA, 14 bp, synthetic construct
  source 1..14: mol_type = other DNA
atttttcgtgggac

SEQ ID NO: 5990 - DNA, 14 bp, synthetic construct
  source 1..14: mol_type = other DNA
caatcctgctttct

SEQ ID NO: 5991 - DNA, 14 bp, synthetic construct
  source 1..14: mol_type = other DNA
cttcattgtagata

SEQ ID NO: 5992 - DNA, 14 bp, synthetic construct
  source 1..14: mol_type = other DNA
tggcttcaatctta

SEQ ID NO: 5993 - DNA, 14 bp, synthetic construct
  source 1..14: mol_type = other DNA
attggtaattctgg

SEQ ID NO: 5994 - DNA, 14 bp, synthetic construct
  source 1..14: mol_type = other DNA
ctgttccttatacc

SEQ ID NO: 5995 - DNA, 14 bp, synthetic construct
  source 1..14: mol_type = other DNA
cactctcttcttcc

SEQ ID NO: 5996 - DNA, 14 bp, synthetic construct
  source 1..14: mol_type = other DNA
aattctttctgcac

SEQ ID NO: 5997 - DNA, 14 bp, synthetic construct
  source 1..14: mol_type = other DNA
aattaccactttgt

SEQ ID NO: 5998 - DNA, 14 bp, synthetic construct
  source 1..14: mol_type = other DNA
ctatttccctgtac

SEQ ID NO: 5999 - DNA, 14 bp, synthetic construct
  source 1..14: mol_type = other DNA
ttgtacgtggattg

SEQ ID NO: 6000 - DNA, 14 bp, synthetic construct
  source 1..14: mol_type = other DNA
cccgaacttttatt

SEQ ID NO: 6001 - DNA, 14 bp, synthetic construct
  source 1..14: mol_type = other DNA
ctttccaattaact

SEQ ID NO: 6002 - DNA, 14 bp, synthetic construct
  source 1..14: mol_type = other DNA
ttcgcttcgtactc

SEQ ID NO: 6003 - DNA, 14 bp, synthetic construct
  source 1..14: mol_type = other DNA
cttgtttgtgaaag

SEQ ID NO: 6004 - DNA, 14 bp, synthetic construct
  source 1..14: mol_type = other DNA
ctctctccttcagt

SEQ ID NO: 6005 - DNA, 14 bp, synthetic construct
  source 1..14: mol_type = other DNA
gcttcgtcgttgtc

SEQ ID NO: 6006 - DNA, 14 bp, synthetic construct
  source 1..14: mol_type = other DNA
ggatctaagctttt

SEQ ID NO: 6007 - DNA, 14 bp, synthetic construct
  source 1..14: mol_type = other DNA
tgatatagttgtac

SEQ ID NO: 6008 - DNA, 14 bp, synthetic construct
  source 1..14: mol_type = other DNA
cttaccgtgtactt

SEQ ID NO: 6009 - DNA, 14 bp, synthetic construct
  source 1..14: mol_type = other DNA
tcattaaatgctat

SEQ ID NO: 6010 - DNA, 14 bp, synthetic construct
  source 1..14: mol_type = other DNA
tgtttgccagtaat

SEQ ID NO: 6011 - DNA, 14 bp, synthetic construct
  source 1..14: mol_type = other DNA
atctttatgatgag

SEQ ID NO: 6012 - DNA, 14 bp, synthetic construct
  source 1..14: mol_type = other DNA
acctctttcctcat

SEQ ID NO: 6013 - DNA, 14 bp, synthetic construct
  source 1..14: mol_type = other DNA
cttatttctagagc

SEQ ID NO: 6014 - DNA, 14 bp, synthetic construct
  source 1..14: mol_type = other DNA
tgttggtactaagt

SEQ ID NO: 6015 - DNA, 14 bp, synthetic construct
  source 1..14: mol_type = other DNA
tccgttatagttag

SEQ ID NO: 6016 - DNA, 14 bp, synthetic construct
  source 1..14: mol_type = other DNA
aaacttgatgttat

SEQ ID NO: 6017 - DNA, 14 bp, synthetic construct
  source 1..14: mol_type = other DNA
attcgtgaatttca

SEQ ID NO: 6018 - DNA, 14 bp, synthetic construct
  source 1..14: mol_type = other DNA
ttgctagttataag

SEQ ID NO: 6019 - DNA, 14 bp, synthetic construct
  source 1..14: mol_type = other DNA
ttgtcctataatca

SEQ ID NO: 6020 - DNA, 14 bp, synthetic construct
  source 1..14: mol_type = other DNA
gggctcgtttactt

SEQ ID NO: 6021 - DNA, 14 bp, synthetic construct
  source 1..14: mol_type = other DNA
ttattgaagcgatt

SEQ ID NO: 6022 - DNA, 14 bp, synthetic construct
  source 1..14: mol_type = other DNA
ttggagtatactgt

SEQ ID NO: 6023 - DNA, 14 bp, synthetic construct
  source 1..14: mol_type = other DNA
aagttactatcttg

SEQ ID NO: 6024 - DNA, 14 bp, synthetic construct
  source 1..14: mol_type = other DNA
gctgacgtcttttc

SEQ ID NO: 6025 - DNA, 14 bp, synthetic construct
  source 1..14: mol_type = other DNA
ttgtgtctaaccat

SEQ ID NO: 6026 - DNA, 14 bp, synthetic construct
  source 1..14: mol_type = other DNA
gtgttctgatgtcg

SEQ ID NO: 6027 - DNA, 14 bp, synthetic construct
  source 1..14: mol_type = other DNA
ccttctaaatctta

SEQ ID NO: 6028 - DNA, 14 bp, synthetic construct
  source 1..14: mol_type = other DNA
gtgatttaatactc

SEQ ID NO: 6029 - DNA, 14 bp, synthetic construct
  source 1..14: mol_type = other DNA
atggctagttgatt

SEQ ID NO: 6030 - DNA, 14 bp, synthetic construct
  source 1..14: mol_type = other DNA
aaggctctttatgt

SEQ ID NO: 6031 - DNA, 14 bp, synthetic construct
  source 1..14: mol_type = other DNA
atcttttacgggat

SEQ ID NO: 6032 - DNA, 14 bp, synthetic construct
  source 1..14: mol_type = other DNA
ctgtgtaattgtcg

SEQ ID NO: 6033 - DNA, 14 bp, synthetic construct
  source 1..14: mol_type = other DNA
taattaagtacctt

SEQ ID NO: 6034 - DNA, 14 bp, synthetic construct
  source 1..14: mol_type = other DNA
aagtttgattctca

SEQ ID NO: 6035 - DNA, 14 bp, synthetic construct
  source 1..14: mol_type = other DNA
gatgttttctggca

SEQ ID NO: 6036 - DNA, 14 bp, synthetic construct
  source 1..14: mol_type = other DNA
tagttcatctatga

SEQ ID NO: 6037 - DNA, 14 bp, synthetic construct
  source 1..14: mol_type = other DNA
aggtatgtttcctc

SEQ ID NO: 6038 - DNA, 14 bp, synthetic construct
  source 1..14: mol_type = other DNA
tcttgctggcgttc

SEQ ID NO: 6039 - DNA, 14 bp, synthetic construct
  source 1..14: mol_type = other DNA
acttgttattgcgc

SEQ ID NO: 6040 - DNA, 14 bp, synthetic construct
  source 1..14: mol_type = other DNA
ccttggcacgtttt

SEQ ID NO: 6041 - DNA, 14 bp, synthetic construct
  source 1..14: mol_type = other DNA
agttgtgattacat

SEQ ID NO: 6042 - DNA, 14 bp, synthetic construct
  source 1..14: mol_type = other DNA
tgtaattgcattac

SEQ ID NO: 6043 - DNA, 14 bp, synthetic construct
  source 1..14: mol_type = other DNA
ccttttgctaggtg

SEQ ID NO: 6044 - DNA, 14 bp, synthetic construct
  source 1..14: mol_type = other DNA
acagctctctgttt

SEQ ID NO: 6045 - DNA, 14 bp, synthetic construct
  source 1..14: mol_type = other DNA
gtctttggtgaggt

SEQ ID NO: 6046 - DNA, 14 bp, synthetic construct
  source 1..14: mol_type = other DNA
acgcatatatattt

SEQ ID NO: 6047 - DNA, 14 bp, synthetic construct
  source 1..14: mol_type = other DNA
gcgattttattgga

SEQ ID NO: 6048 - DNA, 14 bp, synthetic construct
  source 1..14: mol_type = other DNA
ttgctacttccata

SEQ ID NO: 6049 - DNA, 14 bp, synthetic construct
  source 1..14: mol_type = other DNA
tacgtggtcattta

SEQ ID NO: 6050 - DNA, 14 bp, synthetic construct
  source 1..14: mol_type = other DNA
gtactttacatact

SEQ ID NO: 6051 - DNA, 14 bp, synthetic construct
  source 1..14: mol_type = other DNA
agcattgatttata

SEQ ID NO: 6052 - DNA, 14 bp, synthetic construct
  source 1..14: mol_type = other DNA
ttcgttggcgtata

SEQ ID NO: 6053 - DNA, 14 bp, synthetic construct
  source 1..14: mol_type = other DNA
tgttcattacacct

SEQ ID NO: 6054 - DNA, 14 bp, synthetic construct
  source 1..14: mol_type = other DNA
cctttagattatga

SEQ ID NO: 6055 - DNA, 14 bp, synthetic construct
  source 1..14: mol_type = other DNA
ttttcgatcgctcg

SEQ ID NO: 6056 - DNA, 14 bp, synthetic construct
  source 1..14: mol_type = other DNA
attgagcccttttc

SEQ ID NO: 6057 - DNA, 14 bp, synthetic construct
  source 1..14: mol_type = other DNA
acattctttcacta

SEQ ID NO: 6058 - DNA, 14 bp, synthetic construct
  source 1..14: mol_type = other DNA
gttgtcctcctggt

SEQ ID NO: 6059 - DNA, 14 bp, synthetic construct
  source 1..14: mol_type = other DNA
gtatttgttaccgg

SEQ ID NO: 6060 - DNA, 14 bp, synthetic construct
  source 1..14: mol_type = other DNA
tgtaaggtttccat

SEQ ID NO: 6061 - DNA, 14 bp, synthetic construct
  source 1..14: mol_type = other DNA
tcctcatgttagtt

SEQ ID NO: 6062 - DNA, 14 bp, synthetic construct
  source 1..14: mol_type = other DNA
gtgtgtgattttgc

SEQ ID NO: 6063 - DNA, 14 bp, synthetic construct
  source 1..14: mol_type = other DNA
tttttggtgaccat

SEQ ID NO: 6064 - DNA, 14 bp, synthetic construct
  source 1..14: mol_type = other DNA
cttgcagtctttat

SEQ ID NO: 6065 - DNA, 14 bp, synthetic construct
  source 1..14: mol_type = other DNA
tatacctttttgaa

SEQ ID NO: 6066 - DNA, 14 bp, synthetic construct
  source 1..14: mol_type = other DNA
ggttttatctcgtc

SEQ ID NO: 6067 - DNA, 14 bp, synthetic construct
  source 1..14: mol_type = other DNA
tttccgtattactc

SEQ ID NO: 6068 - DNA, 14 bp, synthetic construct
  source 1..14: mol_type = other DNA
atttcctcgttcgt

SEQ ID NO: 6069 - DNA, 14 bp, synthetic construct
  source 1..14: mol_type = other DNA
tttaggtattctcc

SEQ ID NO: 6070 - DNA, 14 bp, synthetic construct
  source 1..14: mol_type = other DNA
ttagctccttcctt

SEQ ID NO: 6071 - DNA, 14 bp, synthetic construct
  source 1..14: mol_type = other DNA
aacgttttcaattt

SEQ ID NO: 6072 - DNA, 14 bp, synthetic construct
  source 1..14: mol_type = other DNA
gcctatttagcttt

SEQ ID NO: 6073 - DNA, 14 bp, synthetic construct
  source 1..14: mol_type = other DNA
catttgctgctttc

SEQ ID NO: 6074 - DNA, 14 bp, synthetic construct
  source 1..14: mol_type = other DNA
tcatctttcgaatt

SEQ ID NO: 6075 - DNA, 14 bp, synthetic construct
  source 1..14: mol_type = other DNA
tatgtcttcatact

SEQ ID NO: 6076 - DNA, 14 bp, synthetic construct
  source 1..14: mol_type = other DNA
cttatctagttcat

SEQ ID NO: 6077 - DNA, 14 bp, synthetic construct
  source 1..14: mol_type = other DNA
taagttctttgatc

SEQ ID NO: 6078 - DNA, 14 bp, synthetic construct
  source 1..14: mol_type = other DNA
gttgtttggtgcta

SEQ ID NO: 6079 - DNA, 14 bp, synthetic construct
  source 1..14: mol_type = other DNA
cgtatcatactttt

SEQ ID NO: 6080 - DNA, 14 bp, synthetic construct
  source 1..14: mol_type = other DNA
tttgcgttcctcgt

SEQ ID NO: 6081 - DNA, 14 bp, synthetic construct
  source 1..14: mol_type = other DNA
ttgctgaattctat

SEQ ID NO: 6082 - DNA, 14 bp, synthetic construct
  source 1..14: mol_type = other DNA
atgttttaacgttc

SEQ ID NO: 6083 - DNA, 14 bp, synthetic construct
  source 1..14: mol_type = other DNA
gctctactattatt

SEQ ID NO: 6084 - DNA, 14 bp, synthetic construct
  source 1..14: mol_type = other DNA
atactttttggtca

SEQ ID NO: 6085 - DNA, 14 bp, synthetic construct
  source 1..14: mol_type = other DNA
ctctttttcgcgtg

SEQ ID NO: 6086 - DNA, 14 bp, synthetic construct
  source 1..14: mol_type = other DNA
gctatattttgtag

SEQ ID NO: 6087 - DNA, 14 bp, synthetic construct
  source 1..14: mol_type = other DNA
gagtgcttattttc

SEQ ID NO: 6088 - DNA, 14 bp, synthetic construct
  source 1..14: mol_type = other DNA
catttgatttactc

SEQ ID NO: 6089 - DNA, 14 bp, synthetic construct
  source 1..14: mol_type = other DNA
tgtgtcagattttc

SEQ ID NO: 6090 - DNA, 14 bp, synthetic construct
  source 1..14: mol_type = other DNA
tgtgttcgtttgca

SEQ ID NO: 6091 - DNA, 14 bp, synthetic construct
  source 1..14: mol_type = other DNA
tcttatcgaattta

SEQ ID NO: 6092 - DNA, 14 bp, synthetic construct
  source 1..14: mol_type = other DNA
tgatatttttcgaa

SEQ ID NO: 6093 - DNA, 14 bp, synthetic construct
  source 1..14: mol_type = other DNA
gaactgtttgtctt

SEQ ID NO: 6094 - DNA, 14 bp, synthetic construct
  source 1..14: mol_type = other DNA
ttttgtagaatgtc

SEQ ID NO: 6095 - DNA, 14 bp, synthetic construct
  source 1..14: mol_type = other DNA
tgggattttcttcg

SEQ ID NO: 6096 - DNA, 14 bp, synthetic construct
  source 1..14: mol_type = other DNA
gtatattgttgctg

SEQ ID NO: 6097 - DNA, 14 bp, synthetic construct
  source 1..14: mol_type = other DNA
tgctttctaattac

SEQ ID NO: 6098 - DNA, 14 bp, synthetic construct
  source 1..14: mol_type = other DNA
taccatttatagtt

SEQ ID NO: 6099 - DNA, 14 bp, synthetic construct
  source 1..14: mol_type = other DNA
gtggttctatgttg

SEQ ID NO: 6100 - DNA, 14 bp, synthetic construct
  source 1..14: mol_type = other DNA
cttttcttgtccgc

SEQ ID NO: 6101 - DNA, 14 bp, synthetic construct
  source 1..14: mol_type = other DNA
atagatgctttatt

SEQ ID NO: 6102 - DNA, 14 bp, synthetic construct
  source 1..14: mol_type = other DNA
tgttttacgttgag

SEQ ID NO: 6103 - DNA, 14 bp, synthetic construct
  source 1..14: mol_type = other DNA
tagtccttgtttgg

SEQ ID NO: 6104 - DNA, 14 bp, synthetic construct
  source 1..14: mol_type = other DNA
tttttggtattctg

SEQ ID NO: 6105 - DNA, 14 bp, synthetic construct
  source 1..14: mol_type = other DNA
tatttttcgtgttt

SEQ ID NO: 6106 - DNA, 14 bp, synthetic construct
  source 1..14: mol_type = other DNA
gtttcgttattttt

SEQ ID NO: 6107 - DNA, 14 bp, synthetic construct
  source 1..14: mol_type = other DNA
agctgtgcgcaaga

SEQ ID NO: 6108 - DNA, 14 bp, synthetic construct
  source 1..14: mol_type = other DNA
ggcggaacctcatg

SEQ ID NO: 6109 - DNA, 14 bp, synthetic construct
  source 1..14: mol_type = other DNA
gagtagggtgaggc

SEQ ID NO: 6110 - DNA, 14 bp, synthetic construct
  source 1..14: mol_type = other DNA
accgtgacggcagt

SEQ ID NO: 6111 - DNA, 14 bp, synthetic construct
  source 1..14: mol_type = other DNA
cccacagcaaaatt

SEQ ID NO: 6112 - DNA, 14 bp, synthetic construct
  source 1..14: mol_type = other DNA
accgaaatcctcac

SEQ ID NO: 6113 - DNA, 14 bp, synthetic construct
  source 1..14: mol_type = other DNA
agaccaagggagtt

SEQ ID NO: 6114 - DNA, 14 bp, synthetic construct
  source 1..14: mol_type = other DNA
taaaggccgaatgg

SEQ ID NO: 6115 - DNA, 14 bp, synthetic construct
  source 1..14: mol_type = other DNA
caccccgttggaaa

SEQ ID NO: 6116 - DNA, 14 bp, synthetic construct
  source 1..14: mol_type = other DNA
gtagccccacaaat

SEQ ID NO: 6117 - DNA, 14 bp, synthetic construct
  source 1..14: mol_type = other DNA
tgagggcgtaacac

SEQ ID NO: 6118 - DNA, 14 bp, synthetic construct
  source 1..14: mol_type = other DNA
agggacgctgcgtg

SEQ ID NO: 6119 - DNA, 14 bp, synthetic construct
  source 1..14: mol_type = other DNA
accaactgacgctc

SEQ ID NO: 6120 - DNA, 14 bp, synthetic construct
  source 1..14: mol_type = other DNA
gcaatcacgcgtaa

SEQ ID NO: 6121 - DNA, 14 bp, synthetic construct
  source 1..14: mol_type = other DNA
tctccggacgcacc

SEQ ID NO: 6122 - DNA, 14 bp, synthetic construct
  source 1..14: mol_type = other DNA
cgggtcgcctgaaa

SEQ ID NO: 6123 - DNA, 14 bp, synthetic construct
  source 1..14: mol_type = other DNA
gaaaaagtaggatg

SEQ ID NO: 6124 - DNA, 14 bp, synthetic construct
  source 1..14: mol_type = other DNA
gaggcggtcataaa

SEQ ID NO: 6125 - DNA, 14 bp, synthetic construct
  source 1..14: mol_type = other DNA
gtggtagcgcgcga

SEQ ID NO: 6126 - DNA, 14 bp, synthetic construct
  source 1..14: mol_type = other DNA
aattccacacaaga

SEQ ID NO: 6127 - DNA, 14 bp, synthetic construct
  source 1..14: mol_type = other DNA
caacggcgtggagt

SEQ ID NO: 6128 - DNA, 14 bp, synthetic construct
  source 1..14: mol_type = other DNA
acgggtcatgggac

SEQ ID NO: 6129 - DNA, 14 bp, synthetic construct
  source 1..14: mol_type = other DNA
ggacctggacacgt

SEQ ID NO: 6130 - DNA, 14 bp, synthetic construct
  source 1..14: mol_type = other DNA
gaaaaatacggtcg

SEQ ID NO: 6131 - DNA, 14 bp, synthetic construct
  source 1..14: mol_type = other DNA
cgcaggacattccc

SEQ ID NO: 6132 - DNA, 14 bp, synthetic construct
  source 1..14: mol_type = other DNA
gttaccgcagggcg

SEQ ID NO: 6133 - DNA, 14 bp, synthetic construct
  source 1..14: mol_type = other DNA
gacaagcccgttga

SEQ ID NO: 6134 - DNA, 14 bp, synthetic construct
  source 1..14: mol_type = other DNA
tgcgtggcgacgac

SEQ ID NO: 6135 - DNA, 14 bp, synthetic construct
  source 1..14: mol_type = other DNA
atcagaacataaga

SEQ ID NO: 6136 - DNA, 14 bp, synthetic construct
  source 1..14: mol_type = other DNA
acaagccgcatgtc

SEQ ID NO: 6137 - DNA, 14 bp, synthetic construct
  source 1..14: mol_type = other DNA
tagaggcgggcctc

SEQ ID NO: 6138 - DNA, 14 bp, synthetic construct
  source 1..14: mol_type = other DNA
catagaagccgtaa

SEQ ID NO: 6139 - DNA, 14 bp, synthetic construct
  source 1..14: mol_type = other DNA
ccgtaggacaagtg

SEQ ID NO: 6140 - DNA, 14 bp, synthetic construct
  source 1..14: mol_type = other DNA
tgagacgcgagcat

SEQ ID NO: 6141 - DNA, 14 bp, synthetic construct
  source 1..14: mol_type = other DNA
ccacacaaatctag

SEQ ID NO: 6142 - DNA, 14 bp, synthetic construct
  source 1..14: mol_type = other DNA
acgccgtccagctg

SEQ ID NO: 6143 - DNA, 14 bp, synthetic construct
  source 1..14: mol_type = other DNA
agagggaccttcac

SEQ ID NO: 6144 - DNA, 14 bp, synthetic construct
  source 1..14: mol_type = other DNA
ctaggcatagccag

SEQ ID NO: 6145 - DNA, 14 bp, synthetic construct
  source 1..14: mol_type = other DNA
gagcacgtccatcc

SEQ ID NO: 6146 - DNA, 14 bp, synthetic construct
  source 1..14: mol_type = other DNA
acaaattcagcgac

SEQ ID NO: 6147 - DNA, 14 bp, synthetic construct
  source 1..14: mol_type = other DNA
agaacatgggtccg

SEQ ID NO: 6148 - DNA, 14 bp, synthetic construct
  source 1..14: mol_type = other DNA
cgcgatgccgcact

SEQ ID NO: 6149 - DNA, 14 bp, synthetic construct
  source 1..14: mol_type = other DNA
gcggagtgtaacaa

SEQ ID NO: 6150 - DNA, 14 bp, synthetic construct
  source 1..14: mol_type = other DNA
gaagctgtagggcg

SEQ ID NO: 6151 - DNA, 14 bp, synthetic construct
  source 1..14: mol_type = other DNA
ccggactcgaccta

SEQ ID NO: 6152 - DNA, 14 bp, synthetic construct
  source 1..14: mol_type = other DNA
cctccgacggtgag

SEQ ID NO: 6153 - DNA, 14 bp, synthetic construct
  source 1..14: mol_type = other DNA
aaggacaacaatat

SEQ ID NO: 6154 - DNA, 14 bp, synthetic construct
  source 1..14: mol_type = other DNA
gagcagagtcgcgt

SEQ ID NO: 6155 - DNA, 14 bp, synthetic construct
  source 1..14: mol_type = other DNA
tgaccgcagcacct

SEQ ID NO: 6156 - DNA, 14 bp, synthetic construct
  source 1..14: mol_type = other DNA
ggcgaccgacctat

SEQ ID NO: 6157 - DNA, 14 bp, synthetic construct
  source 1..14: mol_type = other DNA
tcaggccagacagt

SEQ ID NO: 6158 - DNA, 14 bp, synthetic construct
  source 1..14: mol_type = other DNA
agaatccgcagtga

SEQ ID NO: 6159 - DNA, 14 bp, synthetic construct
  source 1..14: mol_type = other DNA
gacagaatggcaat

SEQ ID NO: 6160 - DNA, 14 bp, synthetic construct
  source 1..14: mol_type = other DNA
actgaactgaggac

SEQ ID NO: 6161 - DNA, 14 bp, synthetic construct
  source 1..14: mol_type = other DNA
agaaagggacgtat

SEQ ID NO: 6162 - DNA, 14 bp, synthetic construct
  source 1..14: mol_type = other DNA
catccgcagcgtaa

SEQ ID NO: 6163 - DNA, 14 bp, synthetic construct
  source 1..14: mol_type = other DNA
cctagtgacggccg

SEQ ID NO: 6164 - DNA, 14 bp, synthetic construct
  source 1..14: mol_type = other DNA
atagccatagagca

SEQ ID NO: 6165 - DNA, 14 bp, synthetic construct
  source 1..14: mol_type = other DNA
agccgtgaacgtcg

SEQ ID NO: 6166 - DNA, 14 bp, synthetic construct
  source 1..14: mol_type = other DNA
aacagaaatcagtc

SEQ ID NO: 6167 - DNA, 14 bp, synthetic construct
  source 1..14: mol_type = other DNA
tacaaaggctagca

SEQ ID NO: 6168 - DNA, 14 bp, synthetic construct
  source 1..14: mol_type = other DNA
cgatgcgaccaact

SEQ ID NO: 6169 - DNA, 14 bp, synthetic construct
  source 1..14: mol_type = other DNA
aggccgactcatac

SEQ ID NO: 6170 - DNA, 14 bp, synthetic construct
  source 1..14: mol_type = other DNA
ctgcggcaccgtgg

SEQ ID NO: 6171 - DNA, 14 bp, synthetic construct
  source 1..14: mol_type = other DNA
aaataaatcgggat

SEQ ID NO: 6172 - DNA, 14 bp, synthetic construct
  source 1..14: mol_type = other DNA
atatggtgagcaac

SEQ ID NO: 6173 - DNA, 14 bp, synthetic construct
  source 1..14: mol_type = other DNA
atgccagaacatat

SEQ ID NO: 6174 - DNA, 14 bp, synthetic construct
  source 1..14: mol_type = other DNA
tcaaagtaacataa

SEQ ID NO: 6175 - DNA, 14 bp, synthetic construct
  source 1..14: mol_type = other DNA
gggcaagctctgtg

SEQ ID NO: 6176 - DNA, 14 bp, synthetic construct
  source 1..14: mol_type = other DNA
gaaggggcttcctc

SEQ ID NO: 6177 - DNA, 14 bp, synthetic construct
  source 1..14: mol_type = other DNA
ctagagggagcttg

SEQ ID NO: 6178 - DNA, 14 bp, synthetic construct
  source 1..14: mol_type = other DNA
agagaatttaggcg

SEQ ID NO: 6179 - DNA, 14 bp, synthetic construct
  source 1..14: mol_type = other DNA
ccgtaaccgccctt

SEQ ID NO: 6180 - DNA, 14 bp, synthetic construct
  source 1..14: mol_type = other DNA
tatgtgcaggggag

SEQ ID NO: 6181 - DNA, 14 bp, synthetic construct
  source 1..14: mol_type = other DNA
aacggtgggttcca

SEQ ID NO: 6182 - DNA, 14 bp, synthetic construct
  source 1..14: mol_type = other DNA
ataaatccaatcac

SEQ ID NO: 6183 - DNA, 14 bp, synthetic construct
  source 1..14: mol_type = other DNA
tagctgactcgggg

SEQ ID NO: 6184 - DNA, 14 bp, synthetic construct
  source 1..14: mol_type = other DNA
gattgacgggctcc

SEQ ID NO: 6185 - DNA, 14 bp, synthetic construct
  source 1..14: mol_type = other DNA
acttataaggcaac

SEQ ID NO: 6186 - DNA, 14 bp, synthetic construct
  source 1..14: mol_type = other DNA
cttgctacacccac

SEQ ID NO: 6187 - DNA, 14 bp, synthetic construct
  source 1..14: mol_type = other DNA
tacctcaaaaatga

SEQ ID NO: 6188 - DNA, 14 bp, synthetic construct
  source 1..14: mol_type = other DNA
tgaagttcaggcga

SEQ ID NO: 6189 - DNA, 14 bp, synthetic construct
  source 1..14: mol_type = other DNA
tgagcccacttacc

SEQ ID NO: 6190 - DNA, 14 bp, synthetic construct
  source 1..14: mol_type = other DNA
attaagcaataccc

SEQ ID NO: 6191 - DNA, 14 bp, synthetic construct
  source 1..14: mol_type = other DNA
gaaatcttccgcga

SEQ ID NO: 6192 - DNA, 14 bp, synthetic construct
  source 1..14: mol_type = other DNA
gaggtagaacaatt

SEQ ID NO: 6193 - DNA, 14 bp, synthetic construct
  source 1..14: mol_type = other DNA
gggtacagtcggtg

SEQ ID NO: 6194 - DNA, 14 bp, synthetic construct
  source 1..14: mol_type = other DNA
ctgtagggcgtcaa

SEQ ID NO: 6195 - DNA, 14 bp, synthetic construct
  source 1..14: mol_type = other DNA
gtaaatcccctacc

SEQ ID NO: 6196 - DNA, 14 bp, synthetic construct
  source 1..14: mol_type = other DNA
gaccattgacggtg

SEQ ID NO: 6197 - DNA, 14 bp, synthetic construct
  source 1..14: mol_type = other DNA
aatggcgaggtgtg

SEQ ID NO: 6198 - DNA, 14 bp, synthetic construct
  source 1..14: mol_type = other DNA
tactgaataacagg

SEQ ID NO: 6199 - DNA, 14 bp, synthetic construct
  source 1..14: mol_type = other DNA
atcatagctcccac

SEQ ID NO: 6200 - DNA, 14 bp, synthetic construct
  source 1..14: mol_type = other DNA
gcgtccttccccac

SEQ ID NO: 6201 - DNA, 14 bp, synthetic construct
  source 1..14: mol_type = other DNA
gctacaactgactg

SEQ ID NO: 6202 - DNA, 14 bp, synthetic construct
  source 1..14: mol_type = other DNA
gtggaggcttcagc

SEQ ID NO: 6203 - DNA, 14 bp, synthetic construct
  source 1..14: mol_type = other DNA
cgatctatcacccc

SEQ ID NO: 6204 - DNA, 14 bp, synthetic construct
  source 1..14: mol_type = other DNA
cccgtctaggcgta

SEQ ID NO: 6205 - DNA, 14 bp, synthetic construct
  source 1..14: mol_type = other DNA
ggctgacctaagtc

SEQ ID NO: 6206 - DNA, 14 bp, synthetic construct
  source 1..14: mol_type = other DNA
cgactggaagttca

SEQ ID NO: 6207 - DNA, 14 bp, synthetic construct
  source 1..14: mol_type = other DNA
agctcaagttcgag

SEQ ID NO: 6208 - DNA, 14 bp, synthetic construct
  source 1..14: mol_type = other DNA
cgttgcggctgaca

SEQ ID NO: 6209 - DNA, 14 bp, synthetic construct
  source 1..14: mol_type = other DNA
gcctaccggtccgt

SEQ ID NO: 6210 - DNA, 14 bp, synthetic construct
  source 1..14: mol_type = other DNA
ggcatacccttggg

SEQ ID NO: 6211 - DNA, 14 bp, synthetic construct
  source 1..14: mol_type = other DNA
gaaaacacttgtca

SEQ ID NO: 6212 - DNA, 14 bp, synthetic construct
  source 1..14: mol_type = other DNA
gctacgtacagcta

SEQ ID NO: 6213 - DNA, 14 bp, synthetic construct
  source 1..14: mol_type = other DNA
tacatgacatacaa

SEQ ID NO: 6214 - DNA, 14 bp, synthetic construct
  source 1..14: mol_type = other DNA
aaatgttaccccga

SEQ ID NO: 6215 - DNA, 14 bp, synthetic construct
  source 1..14: mol_type = other DNA
cccctgatgatgaa

SEQ ID NO: 6216 - DNA, 14 bp, synthetic construct
  source 1..14: mol_type = other DNA
gactctccatgccc

SEQ ID NO: 6217 - DNA, 14 bp, synthetic construct
  source 1..14: mol_type = other DNA
acaccttcccgggt

SEQ ID NO: 6218 - DNA, 14 bp, synthetic construct
  source 1..14: mol_type = other DNA
gacggctgatatga

SEQ ID NO: 6219 - DNA, 14 bp, synthetic construct
  source 1..14: mol_type = other DNA
gggagaggatgatt

SEQ ID NO: 6220 - DNA, 14 bp, synthetic construct
  source 1..14: mol_type = other DNA
agataatggaaagt

SEQ ID NO: 6221 - DNA, 14 bp, synthetic construct
  source 1..14: mol_type = other DNA
accgtaaacggttg

SEQ ID NO: 6222 - DNA, 14 bp, synthetic construct
  source 1..14: mol_type = other DNA
ttataacaaaggca

SEQ ID NO: 6223 - DNA, 14 bp, synthetic construct
  source 1..14: mol_type = other DNA
gatgctgacagtca

SEQ ID NO: 6224 - DNA, 14 bp, synthetic construct
  source 1..14: mol_type = other DNA
gcaacaattcctca

SEQ ID NO: 6225 - DNA, 14 bp, synthetic construct
  source 1..14: mol_type = other DNA
gacgtcatacctac

SEQ ID NO: 6226 - DNA, 14 bp, synthetic construct
  source 1..14: mol_type = other DNA
gactggtgaaaatg

SEQ ID NO: 6227 - DNA, 14 bp, synthetic construct
  source 1..14: mol_type = other DNA
ctccatcgaatcaa

SEQ ID NO: 6228 - DNA, 14 bp, synthetic construct
  source 1..14: mol_type = other DNA
ggtcggggatctca

SEQ ID NO: 6229 - DNA, 14 bp, synthetic construct
  source 1..14: mol_type = other DNA
atacgcgaagtgct

SEQ ID NO: 6230 - DNA, 14 bp, synthetic construct
  source 1..14: mol_type = other DNA
accggctcggtcct

SEQ ID NO: 6231 - DNA, 14 bp, synthetic construct
  source 1..14: mol_type = other DNA
taaatacggtacac

SEQ ID NO: 6232 - DNA, 14 bp, synthetic construct
  source 1..14: mol_type = other DNA
tgggactgagctcc

SEQ ID NO: 6233 - DNA, 14 bp, synthetic construct
  source 1..14: mol_type = other DNA
gttccaacgccaat

SEQ ID NO: 6234 - DNA, 14 bp, synthetic construct
  source 1..14: mol_type = other DNA
ctaaggtaataccg

SEQ ID NO: 6235 - DNA, 14 bp, synthetic construct
  source 1..14: mol_type = other DNA
cctcctcggagggt

SEQ ID NO: 6236 - DNA, 14 bp, synthetic construct
  source 1..14: mol_type = other DNA
acggtatctatacg

SEQ ID NO: 6237 - DNA, 14 bp, synthetic construct
  source 1..14: mol_type = other DNA
atactactaaacta

SEQ ID NO: 6238 - DNA, 14 bp, synthetic construct
  source 1..14: mol_type = other DNA
ctacggtgtactac

SEQ ID NO: 6239 - DNA, 14 bp, synthetic construct
  source 1..14: mol_type = other DNA
tgctataaaggact

SEQ ID NO: 6240 - DNA, 14 bp, synthetic construct
  source 1..14: mol_type = other DNA
aagactttcatcgg

SEQ ID NO: 6241 - DNA, 14 bp, synthetic construct
  source 1..14: mol_type = other DNA
cttccggaccctat

SEQ ID NO: 6242 - DNA, 14 bp, synthetic construct
  source 1..14: mol_type = other DNA
taaaatgcacttcc

SEQ ID NO: 6243 - DNA, 14 bp, synthetic construct
  source 1..14: mol_type = other DNA
aagtcttagtccgg

SEQ ID NO: 6244 - DNA, 14 bp, synthetic construct
  source 1..14: mol_type = other DNA
aattctagtacgcc

SEQ ID NO: 6245 - DNA, 14 bp, synthetic construct
  source 1..14: mol_type = other DNA
ggccgacgcgtttt

SEQ ID NO: 6246 - DNA, 14 bp, synthetic construct
  source 1..14: mol_type = other DNA
tggcatagcgtgtc

SEQ ID NO: 6247 - DNA, 14 bp, synthetic construct
  source 1..14: mol_type = other DNA
tattgccccagtag

SEQ ID NO: 6248 - DNA, 14 bp, synthetic construct
  source 1..14: mol_type = other DNA
tacaagtctctgag

SEQ ID NO: 6249 - DNA, 14 bp, synthetic construct
  source 1..14: mol_type = other DNA
aaaactgtacctgt

SEQ ID NO: 6250 - DNA, 14 bp, synthetic construct
  source 1..14: mol_type = other DNA
tcctacggtgtcgg

SEQ ID NO: 6251 - DNA, 14 bp, synthetic construct
  source 1..14: mol_type = other DNA
tgtaagctcagcgt

SEQ ID NO: 6252 - DNA, 14 bp, synthetic construct
  source 1..14: mol_type = other DNA
cgtacggtaccgtt

SEQ ID NO: 6253 - DNA, 14 bp, synthetic construct
  source 1..14: mol_type = other DNA
tggagggtataatg

SEQ ID NO: 6254 - DNA, 14 bp, synthetic construct
  source 1..14: mol_type = other DNA
acgcaattctaaat

SEQ ID NO: 6255 - DNA, 14 bp, synthetic construct
  source 1..14: mol_type = other DNA
attatgggagatca

SEQ ID NO: 6256 - DNA, 14 bp, synthetic construct
  source 1..14: mol_type = other DNA
tcaatgctataggc

SEQ ID NO: 6257 - DNA, 14 bp, synthetic construct
  source 1..14: mol_type = other DNA
cgtagttgagtgga

SEQ ID NO: 6258 - DNA, 14 bp, synthetic construct
  source 1..14: mol_type = other DNA
acttataccagcta

SEQ ID NO: 6259 - DNA, 14 bp, synthetic construct
  source 1..14: mol_type = other DNA
gaatagtaacgctt

SEQ ID NO: 6260 - DNA, 14 bp, synthetic construct
  source 1..14: mol_type = other DNA
attggaactgtcac

SEQ ID NO: 6261 - DNA, 14 bp, synthetic construct
  source 1..14: mol_type = other DNA
agtactacagattg

SEQ ID NO: 6262 - DNA, 14 bp, synthetic construct
  source 1..14: mol_type = other DNA
acccgctatcctct

SEQ ID NO: 6263 - DNA, 14 bp, synthetic construct
  source 1..14: mol_type = other DNA
taaactaattgcgg

SEQ ID NO: 6264 - DNA, 14 bp, synthetic construct
  source 1..14: mol_type = other DNA
aatactccaatggt

SEQ ID NO: 6265 - DNA, 14 bp, synthetic construct
  source 1..14: mol_type = other DNA
gttccagcagttac

SEQ ID NO: 6266 - DNA, 14 bp, synthetic construct
  source 1..14: mol_type = other DNA
tcgcatgtaagata

SEQ ID NO: 6267 - DNA, 14 bp, synthetic construct
  source 1..14: mol_type = other DNA
tttgcgaagatacg

SEQ ID NO: 6268 - DNA, 14 bp, synthetic construct
  source 1..14: mol_type = other DNA
gacccgtgttaaat

SEQ ID NO: 6269 - DNA, 14 bp, synthetic construct
  source 1..14: mol_type = other DNA
agtgagtgattggg

SEQ ID NO: 6270 - DNA, 14 bp, synthetic construct
  source 1..14: mol_type = other DNA
tgtgtcgctccaca

SEQ ID NO: 6271 - DNA, 14 bp, synthetic construct
  source 1..14: mol_type = other DNA
atgatcacatgggt

SEQ ID NO: 6272 - DNA, 14 bp, synthetic construct
  source 1..14: mol_type = other DNA
gtactgggtgcaat

SEQ ID NO: 6273 - DNA, 14 bp, synthetic construct
  source 1..14: mol_type = other DNA
gaccacttctgctc

SEQ ID NO: 6274 - DNA, 14 bp, synthetic construct
  source 1..14: mol_type = other DNA
gtacgtcaatagtg

SEQ ID NO: 6275 - DNA, 14 bp, synthetic construct
  source 1..14: mol_type = other DNA
tggccctccgttcc

SEQ ID NO: 6276 - DNA, 14 bp, synthetic construct
  source 1..14: mol_type = other DNA
ctggacagtgtctg

SEQ ID NO: 6277 - DNA, 14 bp, synthetic construct
  source 1..14: mol_type = other DNA
ggacagtgttcgta

SEQ ID NO: 6278 - DNA, 14 bp, synthetic construct
  source 1..14: mol_type = other DNA
tagtgccagggttc

SEQ ID NO: 6279 - DNA, 14 bp, synthetic construct
  source 1..14: mol_type = other DNA
tcgggtgctccctg

SEQ ID NO: 6280 - DNA, 14 bp, synthetic construct
  source 1..14: mol_type = other DNA
tacattgtgaacgg

SEQ ID NO: 6281 - DNA, 14 bp, synthetic construct
  source 1..14: mol_type = other DNA
taggttcaacgtca

SEQ ID NO: 6282 - DNA, 14 bp, synthetic construct
  source 1..14: mol_type = other DNA
ccaattgatgaatc

SEQ ID NO: 6283 - DNA, 14 bp, synthetic construct
  source 1..14: mol_type = other DNA
gaaactggttctcg

SEQ ID NO: 6284 - DNA, 14 bp, synthetic construct
  source 1..14: mol_type = other DNA
tggttgtccgaagc

SEQ ID NO: 6285 - DNA, 14 bp, synthetic construct
  source 1..14: mol_type = other DNA
tgtggctcatccga

SEQ ID NO: 6286 - DNA, 14 bp, synthetic construct
  source 1..14: mol_type = other DNA
cagagcgtagttat

SEQ ID NO: 6287 - DNA, 14 bp, synthetic construct
  source 1..14: mol_type = other DNA
aatttaggcccatc

SEQ ID NO: 6288 - DNA, 14 bp, synthetic construct
  source 1..14: mol_type = other DNA
atgaggcgtacatt

SEQ ID NO: 6289 - DNA, 14 bp, synthetic construct
  source 1..14: mol_type = other DNA
tgtataaactgcac

SEQ ID NO: 6290 - DNA, 14 bp, synthetic construct
  source 1..14: mol_type = other DNA
tacctagatcctac

SEQ ID NO: 6291 - DNA, 14 bp, synthetic construct
  source 1..14: mol_type = other DNA
tccagccatatgct

SEQ ID NO: 6292 - DNA, 14 bp, synthetic construct
  source 1..14: mol_type = other DNA
tattagctcacgcg

SEQ ID NO: 6293 - DNA, 14 bp, synthetic construct
  source 1..14: mol_type = other DNA
tcgattcggtgcgg

SEQ ID NO: 6294 - DNA, 14 bp, synthetic construct
  source 1..14: mol_type = other DNA
ctaaatatgagagt

SEQ ID NO: 6295 - DNA, 14 bp, synthetic construct
  source 1..14: mol_type = other DNA
gggtgctttcgaca

SEQ ID NO: 6296 - DNA, 14 bp, synthetic construct
  source 1..14: mol_type = other DNA
aacagatttacatg

SEQ ID NO: 6297 - DNA, 14 bp, synthetic construct
  source 1..14: mol_type = other DNA
aaatagctacatct

SEQ ID NO: 6298 - DNA, 14 bp, synthetic construct
  source 1..14: mol_type = other DNA
aatccctgggctta

SEQ ID NO: 6299 - DNA, 14 bp, synthetic construct
  source 1..14: mol_type = other DNA
cctaacagctcctt

SEQ ID NO: 6300 - DNA, 14 bp, synthetic construct
  source 1..14: mol_type = other DNA
tacagatctcgata

SEQ ID NO: 6301 - DNA, 14 bp, synthetic construct
  source 1..14: mol_type = other DNA
agacatgtcttaga

SEQ ID NO: 6302 - DNA, 14 bp, synthetic construct
  source 1..14: mol_type = other DNA
taattcccctggcg

SEQ ID NO: 6303 - DNA, 14 bp, synthetic construct
  source 1..14: mol_type = other DNA
gtgtagattcgacg

SEQ ID NO: 6304 - DNA, 14 bp, synthetic construct
  source 1..14: mol_type = other DNA
cgtagatattccga

SEQ ID NO: 6305 - DNA, 14 bp, synthetic construct
  source 1..14: mol_type = other DNA
cttacaatcgcctg

SEQ ID NO: 6306 - DNA, 14 bp, synthetic construct
  source 1..14: mol_type = other DNA
cgtacctgggttgg

SEQ ID NO: 6307 - DNA, 14 bp, synthetic construct
  source 1..14: mol_type = other DNA
aatccctatagtcc

SEQ ID NO: 6308 - DNA, 14 bp, synthetic construct
  source 1..14: mol_type = other DNA
cgtccttcaatcaa

SEQ ID NO: 6309 - DNA, 14 bp, synthetic construct
  source 1..14: mol_type = other DNA
tcggagagtcgttg

SEQ ID NO: 6310 - DNA, 14 bp, synthetic construct
  source 1..14: mol_type = other DNA
gtgtgttcagaggg

SEQ ID NO: 6311 - DNA, 14 bp, synthetic construct
  source 1..14: mol_type = other DNA
cggtaacaatcttc

SEQ ID NO: 6312 - DNA, 14 bp, synthetic construct
  source 1..14: mol_type = other DNA
gagctagtaatgta

SEQ ID NO: 6313 - DNA, 14 bp, synthetic construct
  source 1..14: mol_type = other DNA
tgtgctcggtacaa

SEQ ID NO: 6314 - DNA, 14 bp, synthetic construct
  source 1..14: mol_type = other DNA
tgctctcacatagg

SEQ ID NO: 6315 - DNA, 14 bp, synthetic construct
  source 1..14: mol_type = other DNA
catagcgtttgcca

SEQ ID NO: 6316 - DNA, 14 bp, synthetic construct
  source 1..14: mol_type = other DNA
ataccacacttcgt

SEQ ID NO: 6317 - DNA, 14 bp, synthetic construct
  source 1..14: mol_type = other DNA
ggaccgatttatag

SEQ ID NO: 6318 - DNA, 14 bp, synthetic construct
  source 1..14: mol_type = other DNA
acatgtgttccccg

SEQ ID NO: 6319 - DNA, 14 bp, synthetic construct
  source 1..14: mol_type = other DNA
ctgggttcgtccca

SEQ ID NO: 6320 - DNA, 14 bp, synthetic construct
  source 1..14: mol_type = other DNA
gcggacctcctctt

SEQ ID NO: 6321 - DNA, 14 bp, synthetic construct
  source 1..14: mol_type = other DNA
tgctcctaacgata

SEQ ID NO: 6322 - DNA, 14 bp, synthetic construct
  source 1..14: mol_type = other DNA
tctagaccaattat

SEQ ID NO: 6323 - DNA, 14 bp, synthetic construct
  source 1..14: mol_type = other DNA
ggatcccttcttaa

SEQ ID NO: 6324 - DNA, 14 bp, synthetic construct
  source 1..14: mol_type = other DNA
ttgatcgggctgtc

SEQ ID NO: 6325 - DNA, 14 bp, synthetic construct
  source 1..14: mol_type = other DNA
gagccgttgttcct

SEQ ID NO: 6326 - DNA, 14 bp, synthetic construct
  source 1..14: mol_type = other DNA
ggacttcgctgctt

SEQ ID NO: 6327 - DNA, 14 bp, synthetic construct
  source 1..14: mol_type = other DNA
tatcgtgattgggg

SEQ ID NO: 6328 - DNA, 14 bp, synthetic construct
  source 1..14: mol_type = other DNA
ttccgggtcgctgt

SEQ ID NO: 6329 - DNA, 14 bp, synthetic construct
  source 1..14: mol_type = other DNA
gcgatcggtttgct

SEQ ID NO: 6330 - DNA, 14 bp, synthetic construct
  source 1..14: mol_type = other DNA
cccgctttctctga

SEQ ID NO: 6331 - DNA, 14 bp, synthetic construct
  source 1..14: mol_type = other DNA
gtacgcgtttcgtc

SEQ ID NO: 6332 - DNA, 14 bp, synthetic construct
  source 1..14: mol_type = other DNA
aattcagaatcttc

SEQ ID NO: 6333 - DNA, 14 bp, synthetic construct
  source 1..14: mol_type = other DNA
ccatcatggcattt

SEQ ID NO: 6334 - DNA, 14 bp, synthetic construct
  source 1..14: mol_type = other DNA
tgtaaacatcctat

SEQ ID NO: 6335 - DNA, 14 bp, synthetic construct
  source 1..14: mol_type = other DNA
acttaaatgtacat

SEQ ID NO: 6336 - DNA, 14 bp, synthetic construct
  source 1..14: mol_type = other DNA
gttagtcctacggt

SEQ ID NO: 6337 - DNA, 14 bp, synthetic construct
  source 1..14: mol_type = other DNA
ctgtaatgtatcgc

SEQ ID NO: 6338 - DNA, 14 bp, synthetic construct
  source 1..14: mol_type = other DNA
catctcttgggcgt

SEQ ID NO: 6339 - DNA, 14 bp, synthetic construct
  source 1..14: mol_type = other DNA
atgtgacctattgg

SEQ ID NO: 6340 - DNA, 14 bp, synthetic construct
  source 1..14: mol_type = other DNA
gagaatctcttata

SEQ ID NO: 6341 - DNA, 14 bp, synthetic construct
  source 1..14: mol_type = other DNA
ggtcttagcactta

SEQ ID NO: 6342 - DNA, 14 bp, synthetic construct
  source 1..14: mol_type = other DNA
agtcttgacgctct

SEQ ID NO: 6343 - DNA, 14 bp, synthetic construct
  source 1..14: mol_type = other DNA
cctatttctcccaa

SEQ ID NO: 6344 - DNA, 14 bp, synthetic construct
  source 1..14: mol_type = other DNA
tatgtataagctac

SEQ ID NO: 6345 - DNA, 14 bp, synthetic construct
  source 1..14: mol_type = other DNA
actactgcttcgta

SEQ ID NO: 6346 - DNA, 14 bp, synthetic construct
  source 1..14: mol_type = other DNA
tcgtcagtttggca

SEQ ID NO: 6347 - DNA, 14 bp, synthetic construct
  source 1..14: mol_type = other DNA
taactgtggtggct

SEQ ID NO: 6348 - DNA, 14 bp, synthetic construct
  source 1..14: mol_type = other DNA
gtcgatttatgcag

SEQ ID NO: 6349 - DNA, 14 bp, synthetic construct
  source 1..14: mol_type = other DNA
cgtatatgtcatac

SEQ ID NO: 6350 - DNA, 14 bp, synthetic construct
  source 1..14: mol_type = other DNA
ttatcgtccggatc

SEQ ID NO: 6351 - DNA, 14 bp, synthetic construct
  source 1..14: mol_type = other DNA
ttatgggtacgagt

SEQ ID NO: 6352 - DNA, 14 bp, synthetic construct
  source 1..14: mol_type = other DNA
tgtttcgtccccgg

SEQ ID NO: 6353 - DNA, 14 bp, synthetic construct
  source 1..14: mol_type = other DNA
tctcagacttctgc

SEQ ID NO: 6354 - DNA, 14 bp, synthetic construct
  source 1..14: mol_type = other DNA
ctaccatatgtctg

SEQ ID NO: 6355 - DNA, 14 bp, synthetic construct
  source 1..14: mol_type = other DNA
gagttggacgtttc

SEQ ID NO: 6356 - DNA, 14 bp, synthetic construct
  source 1..14: mol_type = other DNA
attagcctcttcag

SEQ ID NO: 6357 - DNA, 14 bp, synthetic construct
  source 1..14: mol_type = other DNA
ctattatgatacga

SEQ ID NO: 6358 - DNA, 14 bp, synthetic construct
  source 1..14: mol_type = other DNA
gtatcataccttga

SEQ ID NO: 6359 - DNA, 14 bp, synthetic construct
  source 1..14: mol_type = other DNA
ttgtataaaccctg

SEQ ID NO: 6360 - DNA, 14 bp, synthetic construct
  source 1..14: mol_type = other DNA
ttccgcgtaaactt

SEQ ID NO: 6361 - DNA, 14 bp, synthetic construct
  source 1..14: mol_type = other DNA
tacttgtaaactaa

SEQ ID NO: 6362 - DNA, 14 bp, synthetic construct
  source 1..14: mol_type = other DNA
cccctttttcagga

SEQ ID NO: 6363 - DNA, 14 bp, synthetic construct
  source 1..14: mol_type = other DNA
tttagtgagagcct

SEQ ID NO: 6364 - DNA, 14 bp, synthetic construct
  source 1..14: mol_type = other DNA
aacttttcatagac

SEQ ID NO: 6365 - DNA, 14 bp, synthetic construct
  source 1..14: mol_type = other DNA
tcgcttagtaagtt

SEQ ID NO: 6366 - DNA, 14 bp, synthetic construct
  source 1..14: mol_type = other DNA
taaacatgcatttt

SEQ ID NO: 6367 - DNA, 14 bp, synthetic construct
  source 1..14: mol_type = other DNA
gtttatcccttcga

SEQ ID NO: 6368 - DNA, 14 bp, synthetic construct
  source 1..14: mol_type = other DNA
cgattgattcttcc

SEQ ID NO: 6369 - DNA, 14 bp, synthetic construct
  source 1..14: mol_type = other DNA
actgtcatcttgta

SEQ ID NO: 6370 - DNA, 14 bp, synthetic construct
  source 1..14: mol_type = other DNA
gacttcgtttgcgt

SEQ ID NO: 6371 - DNA, 14 bp, synthetic construct
  source 1..14: mol_type = other DNA
ttatatgaggttgt

SEQ ID NO: 6372 - DNA, 14 bp, synthetic construct
  source 1..14: mol_type = other DNA
tttcaagattcttc

SEQ ID NO: 6373 - DNA, 14 bp, synthetic construct
  source 1..14: mol_type = other DNA
tgatttattccatg

SEQ ID NO: 6374 - DNA, 14 bp, synthetic construct
  source 1..14: mol_type = other DNA
ttagagcttcttct

SEQ ID NO: 6375 - DNA, 14 bp, synthetic construct
  source 1..14: mol_type = other DNA
cgaatgtgttttta

SEQ ID NO: 6376 - DNA, 14 bp, synthetic construct
  source 1..14: mol_type = other DNA
gatgtctacttttg

SEQ ID NO: 6377 - DNA, 14 bp, synthetic construct
  source 1..14: mol_type = other DNA
tctgttcgctcatt

SEQ ID NO: 6378 - DNA, 14 bp, synthetic construct
  source 1..14: mol_type = other DNA
tttggttcagtgtg

SEQ ID NO: 6379 - DNA, 14 bp, synthetic construct
  source 1..14: mol_type = other DNA
gctactccttttat

SEQ ID NO: 6380 - DNA, 14 bp, synthetic construct
  source 1..14: mol_type = other DNA
attggtattatgat

SEQ ID NO: 6381 - DNA, 14 bp, synthetic construct
  source 1..14: mol_type = other DNA
cgattactatttgt

SEQ ID NO: 6382 - DNA, 14 bp, synthetic construct
  source 1..14: mol_type = other DNA
ttagcatatcattt

SEQ ID NO: 6383 - DNA, 14 bp, synthetic construct
  source 1..14: mol_type = other DNA
tgttcgaatctttg

SEQ ID NO: 6384 - DNA, 14 bp, synthetic construct
  source 1..14: mol_type = other DNA
cccttgttcttctg

SEQ ID NO: 6385 - DNA, 14 bp, synthetic construct
  source 1..14: mol_type = other DNA
atgtctgttgttac

SEQ ID NO: 6386 - DNA, 14 bp, synthetic construct
  source 1..14: mol_type = other DNA
tatgttttacacta

SEQ ID NO: 6387 - DNA, 14 bp, synthetic construct
  source 1..14: mol_type = other DNA
tttacctgttaatg

SEQ ID NO: 6388 - DNA, 14 bp, synthetic construct
  source 1..14: mol_type = other DNA
actttatgtgttag

SEQ ID NO: 6389 - DNA, 14 bp, synthetic construct
  source 1..14: mol_type = other DNA
atgtgttcctgtta

SEQ ID NO: 6390 - DNA, 14 bp, synthetic construct
  source 1..14: mol_type = other DNA
ctcccttacctttt

SEQ ID NO: 6391 - DNA, 14 bp, synthetic construct
  source 1..14: mol_type = other DNA
tgtcgttgttgtgc

SEQ ID NO: 6392 - DNA, 14 bp, synthetic construct
  source 1..14: mol_type = other DNA
aatttgcgttttac

SEQ ID NO: 6393 - DNA, 14 bp, synthetic construct
  source 1..14: mol_type = other DNA
tttttccgactgtg

SEQ ID NO: 6394 - DNA, 14 bp, synthetic construct
  source 1..14: mol_type = other DNA
ttttagagtttccc

SEQ ID NO: 6395 - DNA, 14 bp, synthetic construct
  source 1..14: mol_type = other DNA
ggcgtgttattgtt

SEQ ID NO: 6396 - DNA, 14 bp, synthetic construct
  source 1..14: mol_type = other DNA
tgtgaactttttag

SEQ ID NO: 6397 - DNA, 14 bp, synthetic construct
  source 1..14: mol_type = other DNA
tccaacatttttct

SEQ ID NO: 6398 - DNA, 14 bp, synthetic construct
  source 1..14: mol_type = other DNA
tatttttggccact

SEQ ID NO: 6399 - DNA, 14 bp, synthetic construct
  source 1..14: mol_type = other DNA
gatagttatcttat

SEQ ID NO: 6400 - DNA, 14 bp, synthetic construct
  source 1..14: mol_type = other DNA
gttatcttatgcct

SEQ ID NO: 6401 - DNA, 14 bp, synthetic construct
  source 1..14: mol_type = other DNA
gttttctgcttagc

SEQ ID NO: 6402 - DNA, 14 bp, synthetic construct
  source 1..14: mol_type = other DNA
atttgggagtgttt

SEQ ID NO: 6403 - DNA, 14 bp, synthetic construct
  source 1..14: mol_type = other DNA
tgttatgtgctgtc

SEQ ID NO: 6404 - DNA, 14 bp, synthetic construct
  source 1..14: mol_type = other DNA
gggtgtatatgttt

SEQ ID NO: 6405 - DNA, 14 bp, synthetic construct
  source 1..14: mol_type = other DNA
tgtgtcttatggta

SEQ ID NO: 6406 - DNA, 14 bp, synthetic construct
  source 1..14: mol_type = other DNA
tattgtactctact

SEQ ID NO: 6407 - DNA, 14 bp, synthetic construct
  source 1..14: mol_type = other DNA
cctaatgatttttc

SEQ ID NO: 6408 - DNA, 14 bp, synthetic construct
  source 1..14: mol_type = other DNA
accacactcaacca

SEQ ID NO: 6409 - DNA, 14 bp, synthetic construct
  source 1..14: mol_type = other DNA
ctaaacccgggggg

SEQ ID NO: 6410 - DNA, 14 bp, synthetic construct
  source 1..14: mol_type = other DNA
cggcatccgacgac

SEQ ID NO: 6411 - DNA, 14 bp, synthetic construct
  source 1..14: mol_type = other DNA
gccgatagcccgac

SEQ ID NO: 6412 - DNA, 14 bp, synthetic construct
  source 1..14: mol_type = other DNA
aagatccggacggc

SEQ ID NO: 6413 - DNA, 14 bp, synthetic construct
  source 1..14: mol_type = other DNA
cagcaggtagcgaa

SEQ ID NO: 6414 - DNA, 14 bp, synthetic construct
  source 1..14: mol_type = other DNA
gacaccccaaatgc

SEQ ID NO: 6415 - DNA, 14 bp, synthetic construct
  source 1..14: mol_type = other DNA
gactagccaccaca

SEQ ID NO: 6416 - DNA, 14 bp, synthetic construct
  source 1..14: mol_type = other DNA
gcgcagctaccaac

SEQ ID NO: 6417 - DNA, 14 bp, synthetic construct
  source 1..14: mol_type = other DNA
acgatccgggaccg

SEQ ID NO: 6418 - DNA, 14 bp, synthetic construct
  source 1..14: mol_type = other DNA
cgccaaccagatca

SEQ ID NO: 6419 - DNA, 14 bp, synthetic construct
  source 1..14: mol_type = other DNA
ggcagccggatgac

SEQ ID NO: 6420 - DNA, 14 bp, synthetic construct
  source 1..14: mol_type = other DNA
gagaacgcggtcgg

SEQ ID NO: 6421 - DNA, 14 bp, synthetic construct
  source 1..14: mol_type = other DNA
accacccgaacata

SEQ ID NO: 6422 - DNA, 14 bp, synthetic construct
  source 1..14: mol_type = other DNA
gacaatagcaacac

SEQ ID NO: 6423 - DNA, 14 bp, synthetic construct
  source 1..14: mol_type = other DNA
acaaatgagcaagg

SEQ ID NO: 6424 - DNA, 14 bp, synthetic construct
  source 1..14: mol_type = other DNA
agatgaccaaccac

SEQ ID NO: 6425 - DNA, 14 bp, synthetic construct
  source 1..14: mol_type = other DNA
agggactggcgggg

SEQ ID NO: 6426 - DNA, 14 bp, synthetic construct
  source 1..14: mol_type = other DNA
aggaccggaccctc

SEQ ID NO: 6427 - DNA, 14 bp, synthetic construct
  source 1..14: mol_type = other DNA
gcaaatcaaggcga

SEQ ID NO: 6428 - DNA, 14 bp, synthetic construct
  source 1..14: mol_type = other DNA
aagacaaaaggcta

SEQ ID NO: 6429 - DNA, 14 bp, synthetic construct
  source 1..14: mol_type = other DNA
tcgaccgaccgaac

SEQ ID NO: 6430 - DNA, 14 bp, synthetic construct
  source 1..14: mol_type = other DNA
caggtccccaggac

SEQ ID NO: 6431 - DNA, 14 bp, synthetic construct
  source 1..14: mol_type = other DNA
gcggatcccaccgg

SEQ ID NO: 6432 - DNA, 14 bp, synthetic construct
  source 1..14: mol_type = other DNA
acaggactaacaca

SEQ ID NO: 6433 - DNA, 14 bp, synthetic construct
  source 1..14: mol_type = other DNA
gaaggatgccacgc

SEQ ID NO: 6434 - DNA, 14 bp, synthetic construct
  source 1..14: mol_type = other DNA
aaaagagcctgcag

SEQ ID NO: 6435 - DNA, 14 bp, synthetic construct
  source 1..14: mol_type = other DNA
gagcggagctagca

SEQ ID NO: 6436 - DNA, 14 bp, synthetic construct
  source 1..14: mol_type = other DNA
atcgagcgcgcgca

SEQ ID NO: 6437 - DNA, 14 bp, synthetic construct
  source 1..14: mol_type = other DNA
gaacaccctccgcc

SEQ ID NO: 6438 - DNA, 14 bp, synthetic construct
  source 1..14: mol_type = other DNA
ccgcacgctcaacc

SEQ ID NO: 6439 - DNA, 14 bp, synthetic construct
  source 1..14: mol_type = other DNA
cgaagaagtgcaag

SEQ ID NO: 6440 - DNA, 14 bp, synthetic construct
  source 1..14: mol_type = other DNA
gtgcaaaaaggacc

SEQ ID NO: 6441 - DNA, 14 bp, synthetic construct
  source 1..14: mol_type = other DNA
ggcccaaccctaag

SEQ ID NO: 6442 - DNA, 14 bp, synthetic construct
  source 1..14: mol_type = other DNA
gcaaagaaggtcaa

SEQ ID NO: 6443 - DNA, 14 bp, synthetic construct
  source 1..14: mol_type = other DNA
gagacaatccccag

SEQ ID NO: 6444 - DNA, 14 bp, synthetic construct
  source 1..14: mol_type = other DNA
cagccaaacagtag

SEQ ID NO: 6445 - DNA, 14 bp, synthetic construct
  source 1..14: mol_type = other DNA
aggtcagggacgac

SEQ ID NO: 6446 - DNA, 14 bp, synthetic construct
  source 1..14: mol_type = other DNA
caacagccgccgta

SEQ ID NO: 6447 - DNA, 14 bp, synthetic construct
  source 1..14: mol_type = other DNA
ccgccaggactcga

SEQ ID NO: 6448 - DNA, 14 bp, synthetic construct
  source 1..14: mol_type = other DNA
gtccccaacgaagc

SEQ ID NO: 6449 - DNA, 14 bp, synthetic construct
  source 1..14: mol_type = other DNA
acgggcacaagcat

SEQ ID NO: 6450 - DNA, 14 bp, synthetic construct
  source 1..14: mol_type = other DNA
acccgatggccagg

SEQ ID NO: 6451 - DNA, 14 bp, synthetic construct
  source 1..14: mol_type = other DNA
ccaacacggccatc

SEQ ID NO: 6452 - DNA, 14 bp, synthetic construct
  source 1..14: mol_type = other DNA
cccagcacgtgggg

SEQ ID NO: 6453 - DNA, 14 bp, synthetic construct
  source 1..14: mol_type = other DNA
acgcatgacccccc

SEQ ID NO: 6454 - DNA, 14 bp, synthetic construct
  source 1..14: mol_type = other DNA
ccctccaccgaaca

SEQ ID NO: 6455 - DNA, 14 bp, synthetic construct
  source 1..14: mol_type = other DNA
gagcccgaagaata

SEQ ID NO: 6456 - DNA, 14 bp, synthetic construct
  source 1..14: mol_type = other DNA
ccagcataacgggc

SEQ ID NO: 6457 - DNA, 14 bp, synthetic construct
  source 1..14: mol_type = other DNA
atcacagccgagcc

SEQ ID NO: 6458 - DNA, 14 bp, synthetic construct
  source 1..14: mol_type = other DNA
gccacccagcctcc

SEQ ID NO: 6459 - DNA, 14 bp, synthetic construct
  source 1..14: mol_type = other DNA
ggataacccgcaaa

SEQ ID NO: 6460 - DNA, 14 bp, synthetic construct
  source 1..14: mol_type = other DNA
acgcatcccgccaa

SEQ ID NO: 6461 - DNA, 14 bp, synthetic construct
  source 1..14: mol_type = other DNA
acgaaaacagtacc

SEQ ID NO: 6462 - DNA, 14 bp, synthetic construct
  source 1..14: mol_type = other DNA
tgacaggacacgag

SEQ ID NO: 6463 - DNA, 14 bp, synthetic construct
  source 1..14: mol_type = other DNA
gcaggcaaaatggg

SEQ ID NO: 6464 - DNA, 14 bp, synthetic construct
  source 1..14: mol_type = other DNA
atgacacggagagc

SEQ ID NO: 6465 - DNA, 14 bp, synthetic construct
  source 1..14: mol_type = other DNA
acaggtgccgacca

SEQ ID NO: 6466 - DNA, 14 bp, synthetic construct
  source 1..14: mol_type = other DNA
gccgaacggcacat

SEQ ID NO: 6467 - DNA, 14 bp, synthetic construct
  source 1..14: mol_type = other DNA
aagtgggccggcca

SEQ ID NO: 6468 - DNA, 14 bp, synthetic construct
  source 1..14: mol_type = other DNA
gcgaacgctggccc

SEQ ID NO: 6469 - DNA, 14 bp, synthetic construct
  source 1..14: mol_type = other DNA
gcaaaaacgacgta

SEQ ID NO: 6470 - DNA, 14 bp, synthetic construct
  source 1..14: mol_type = other DNA
ggaacaaaagtggc

SEQ ID NO: 6471 - DNA, 14 bp, synthetic construct
  source 1..14: mol_type = other DNA
acgggcaggaagtc

SEQ ID NO: 6472 - DNA, 14 bp, synthetic construct
  source 1..14: mol_type = other DNA
cccacgaaatcgcc

SEQ ID NO: 6473 - DNA, 14 bp, synthetic construct
  source 1..14: mol_type = other DNA
tccgcagccaggac

SEQ ID NO: 6474 - DNA, 14 bp, synthetic construct
  source 1..14: mol_type = other DNA
tccgaggagcacaa

SEQ ID NO: 6475 - DNA, 14 bp, synthetic construct
  source 1..14: mol_type = other DNA
cacaccagtagaga

SEQ ID NO: 6476 - DNA, 14 bp, synthetic construct
  source 1..14: mol_type = other DNA
gcccgagtccgaga

SEQ ID NO: 6477 - DNA, 14 bp, synthetic construct
  source 1..14: mol_type = other DNA
cgcgaccgcatgcc

SEQ ID NO: 6478 - DNA, 14 bp, synthetic construct
  source 1..14: mol_type = other DNA
caccaaatacccac

SEQ ID NO: 6479 - DNA, 14 bp, synthetic construct
  source 1..14: mol_type = other DNA
agacctacgccaga

SEQ ID NO: 6480 - DNA, 14 bp, synthetic construct
  source 1..14: mol_type = other DNA
cccgaggactggac

SEQ ID NO: 6481 - DNA, 14 bp, synthetic construct
  source 1..14: mol_type = other DNA
gataaccgggaagg

SEQ ID NO: 6482 - DNA, 14 bp, synthetic construct
  source 1..14: mol_type = other DNA
acctcggaacaaga

SEQ ID NO: 6483 - DNA, 14 bp, synthetic construct
  source 1..14: mol_type = other DNA
gcgagcgcagatgg

SEQ ID NO: 6484 - DNA, 14 bp, synthetic construct
  source 1..14: mol_type = other DNA
cccgcacctcagca

SEQ ID NO: 6485 - DNA, 14 bp, synthetic construct
  source 1..14: mol_type = other DNA
tgcagggaggacca

SEQ ID NO: 6486 - DNA, 14 bp, synthetic construct
  source 1..14: mol_type = other DNA
ccgacagaccatgg

SEQ ID NO: 6487 - DNA, 14 bp, synthetic construct
  source 1..14: mol_type = other DNA
gacggcagtgcaga

SEQ ID NO: 6488 - DNA, 14 bp, synthetic construct
  source 1..14: mol_type = other DNA
cacaagaaatggga

SEQ ID NO: 6489 - DNA, 14 bp, synthetic construct
  source 1..14: mol_type = other DNA
aacggccaagcact

SEQ ID NO: 6490 - DNA, 14 bp, synthetic construct
  source 1..14: mol_type = other DNA
gaagggctgaacga

SEQ ID NO: 6491 - DNA, 14 bp, synthetic construct
  source 1..14: mol_type = other DNA
cagcacaccatgag

SEQ ID NO: 6492 - DNA, 14 bp, synthetic construct
  source 1..14: mol_type = other DNA
gggaaagcggaaat

SEQ ID NO: 6493 - DNA, 14 bp, synthetic construct
  source 1..14: mol_type = other DNA
gggaggacgcagtg

SEQ ID NO: 6494 - DNA, 14 bp, synthetic construct
  source 1..14: mol_type = other DNA
cggagtgccggaag

SEQ ID NO: 6495 - DNA, 14 bp, synthetic construct
  source 1..14: mol_type = other DNA
ggagcgatccgcac

SEQ ID NO: 6496 - DNA, 14 bp, synthetic construct
  source 1..14: mol_type = other DNA
agaaccaacatgaa

SEQ ID NO: 6497 - DNA, 14 bp, synthetic construct
  source 1..14: mol_type = other DNA
gggacccatagacg

SEQ ID NO: 6498 - DNA, 14 bp, synthetic construct
  source 1..14: mol_type = other DNA
aataaagagcccac

SEQ ID NO: 6499 - DNA, 14 bp, synthetic construct
  source 1..14: mol_type = other DNA
tggacggagagcgg

SEQ ID NO: 6500 - DNA, 14 bp, synthetic construct
  source 1..14: mol_type = other DNA
gagaccaccgatcg

SEQ ID NO: 6501 - DNA, 14 bp, synthetic construct
  source 1..14: mol_type = other DNA
cgcgagcgcaacgt

SEQ ID NO: 6502 - DNA, 14 bp, synthetic construct
  source 1..14: mol_type = other DNA
agcccgataaacaa

SEQ ID NO: 6503 - DNA, 14 bp, synthetic construct
  source 1..14: mol_type = other DNA
tgagaagcaaaaac

SEQ ID NO: 6504 - DNA, 14 bp, synthetic construct
  source 1..14: mol_type = other DNA
agtccagcgccgcg

SEQ ID NO: 6505 - DNA, 14 bp, synthetic construct
  source 1..14: mol_type = other DNA
cgacctgcccgaac

SEQ ID NO: 6506 - DNA, 14 bp, synthetic construct
  source 1..14: mol_type = other DNA
gaaaaaccgtgaga

SEQ ID NO: 6507 - DNA, 14 bp, synthetic construct
  source 1..14: mol_type = other DNA
agacgtccgagacc

SEQ ID NO: 6508 - DNA, 14 bp, synthetic construct
  source 1..14: mol_type = other DNA
ccactgcacgcaca

SEQ ID NO: 6509 - DNA, 14 bp, synthetic construct
  source 1..14: mol_type = other DNA
cacagagtccagcg

SEQ ID NO: 6510 - DNA, 14 bp, synthetic construct
  source 1..14: mol_type = other DNA
cctagagagccaga

SEQ ID NO: 6511 - DNA, 14 bp, synthetic construct
  source 1..14: mol_type = other DNA
cagggatagagcgg

SEQ ID NO: 6512 - DNA, 14 bp, synthetic construct
  source 1..14: mol_type = other DNA
caggcagccgcagt

SEQ ID NO: 6513 - DNA, 14 bp, synthetic construct
  source 1..14: mol_type = other DNA
gcacgcacgtaccg

SEQ ID NO: 6514 - DNA, 14 bp, synthetic construct
  source 1..14: mol_type = other DNA
caaaaggtacaccc

SEQ ID NO: 6515 - DNA, 14 bp, synthetic construct
  source 1..14: mol_type = other DNA
ccataagaaagaac

SEQ ID NO: 6516 - DNA, 14 bp, synthetic construct
  source 1..14: mol_type = other DNA
cacctccggagcag

SEQ ID NO: 6517 - DNA, 14 bp, synthetic construct
  source 1..14: mol_type = other DNA
tgaagcaaacaaga

SEQ ID NO: 6518 - DNA, 14 bp, synthetic construct
  source 1..14: mol_type = other DNA
ccatggcacaaacc

SEQ ID NO: 6519 - DNA, 14 bp, synthetic construct
  source 1..14: mol_type = other DNA
aacggggaccgatc

SEQ ID NO: 6520 - DNA, 14 bp, synthetic construct
  source 1..14: mol_type = other DNA
aactaaacgcagga

SEQ ID NO: 6521 - DNA, 14 bp, synthetic construct
  source 1..14: mol_type = other DNA
cgtggccagaggca

SEQ ID NO: 6522 - DNA, 14 bp, synthetic construct
  source 1..14: mol_type = other DNA
cccctacgaacgaa

SEQ ID NO: 6523 - DNA, 14 bp, synthetic construct
  source 1..14: mol_type = other DNA
ctgagagaaagcaa

SEQ ID NO: 6524 - DNA, 14 bp, synthetic construct
  source 1..14: mol_type = other DNA
tcgcccagaagccc

SEQ ID NO: 6525 - DNA, 14 bp, synthetic construct
  source 1..14: mol_type = other DNA
gatcacgcacgcgc

SEQ ID NO: 6526 - DNA, 14 bp, synthetic construct
  source 1..14: mol_type = other DNA
cacgcactggcaca

SEQ ID NO: 6527 - DNA, 14 bp, synthetic construct
  source 1..14: mol_type = other DNA
gggagcccaaataa

SEQ ID NO: 6528 - DNA, 14 bp, synthetic construct
  source 1..14: mol_type = other DNA
acacagcaaggtcc

SEQ ID NO: 6529 - DNA, 14 bp, synthetic construct
  source 1..14: mol_type = other DNA
aaaggaagaataga

SEQ ID NO: 6530 - DNA, 14 bp, synthetic construct
  source 1..14: mol_type = other DNA
cgacgaatcgacac

SEQ ID NO: 6531 - DNA, 14 bp, synthetic construct
  source 1..14: mol_type = other DNA
gcgctgagcggagg

SEQ ID NO: 6532 - DNA, 14 bp, synthetic construct
  source 1..14: mol_type = other DNA
gcgagaacgggcct

SEQ ID NO: 6533 - DNA, 14 bp, synthetic construct
  source 1..14: mol_type = other DNA
cgcagcgcacgagt

SEQ ID NO: 6534 - DNA, 14 bp, synthetic construct
  source 1..14: mol_type = other DNA
gtccggacggcagc

SEQ ID NO: 6535 - DNA, 14 bp, synthetic construct
  source 1..14: mol_type = other DNA
ctgagccagacacc

SEQ ID NO: 6536 - DNA, 14 bp, synthetic construct
  source 1..14: mol_type = other DNA
aaccatcgggcaca

SEQ ID NO: 6537 - DNA, 14 bp, synthetic construct
  source 1..14: mol_type = other DNA
cacatacgccccag

SEQ ID NO: 6538 - DNA, 14 bp, synthetic construct
  source 1..14: mol_type = other DNA
aggcccaaatacag

SEQ ID NO: 6539 - DNA, 14 bp, synthetic construct
  source 1..14: mol_type = other DNA
cgggcaatcagaaa

SEQ ID NO: 6540 - DNA, 14 bp, synthetic construct
  source 1..14: mol_type = other DNA
ggaatcagagaaag

SEQ ID NO: 6541 - DNA, 14 bp, synthetic construct
  source 1..14: mol_type = other DNA
gaagatacaaccaa

SEQ ID NO: 6542 - DNA, 14 bp, synthetic construct
  source 1..14: mol_type = other DNA
ccgactcgagggac

SEQ ID NO: 6543 - DNA, 14 bp, synthetic construct
  source 1..14: mol_type = other DNA
tgggcgaacccagc

SEQ ID NO: 6544 - DNA, 14 bp, synthetic construct
  source 1..14: mol_type = other DNA
agcctcggcagcac

SEQ ID NO: 6545 - DNA, 14 bp, synthetic construct
  source 1..14: mol_type = other DNA
actgcccagaaagg

SEQ ID NO: 6546 - DNA, 14 bp, synthetic construct
  source 1..14: mol_type = other DNA
cacccccaccagtc

SEQ ID NO: 6547 - DNA, 14 bp, synthetic construct
  source 1..14: mol_type = other DNA
cccagagaacgatg

SEQ ID NO: 6548 - DNA, 14 bp, synthetic construct
  source 1..14: mol_type = other DNA
cgtagacaccaaac

SEQ ID NO: 6549 - DNA, 14 bp, synthetic construct
  source 1..14: mol_type = other DNA
cagccatacgcgga

SEQ ID NO: 6550 - DNA, 14 bp, synthetic construct
  source 1..14: mol_type = other DNA
gggtaacagagaag

SEQ ID NO: 6551 - DNA, 14 bp, synthetic construct
  source 1..14: mol_type = other DNA
cacctgcaccgaga

SEQ ID NO: 6552 - DNA, 14 bp, synthetic construct
  source 1..14: mol_type = other DNA
gaggataagagaga

SEQ ID NO: 6553 - DNA, 14 bp, synthetic construct
  source 1..14: mol_type = other DNA
gggagacaccaggt

SEQ ID NO: 6554 - DNA, 14 bp, synthetic construct
  source 1..14: mol_type = other DNA
ccgacaagcaatcc

SEQ ID NO: 6555 - DNA, 14 bp, synthetic construct
  source 1..14: mol_type = other DNA
ccagatgctaaggc

SEQ ID NO: 6556 - DNA, 14 bp, synthetic construct
  source 1..14: mol_type = other DNA
aggatatcagagca

SEQ ID NO: 6557 - DNA, 14 bp, synthetic construct
  source 1..14: mol_type = other DNA
gtacacgaggacct

SEQ ID NO: 6558 - DNA, 14 bp, synthetic construct
  source 1..14: mol_type = other DNA
cgagtccggtcgac

SEQ ID NO: 6559 - DNA, 14 bp, synthetic construct
  source 1..14: mol_type = other DNA
gcatggactcaaac

SEQ ID NO: 6560 - DNA, 14 bp, synthetic construct
  source 1..14: mol_type = other DNA
gtaggtgacgcgag

SEQ ID NO: 6561 - DNA, 14 bp, synthetic construct
  source 1..14: mol_type = other DNA
gagcgggagtgcta

SEQ ID NO: 6562 - DNA, 14 bp, synthetic construct
  source 1..14: mol_type = other DNA
ggaaggctggcgta

SEQ ID NO: 6563 - DNA, 14 bp, synthetic construct
  source 1..14: mol_type = other DNA
agcagggggtctcg

SEQ ID NO: 6564 - DNA, 14 bp, synthetic construct
  source 1..14: mol_type = other DNA
tagagaaggaggtc

SEQ ID NO: 6565 - DNA, 14 bp, synthetic construct
  source 1..14: mol_type = other DNA
ggaggccctggtcc

SEQ ID NO: 6566 - DNA, 14 bp, synthetic construct
  source 1..14: mol_type = other DNA
agtgcgaccgaagt

SEQ ID NO: 6567 - DNA, 14 bp, synthetic construct
  source 1..14: mol_type = other DNA
ctagcagcaagctg

SEQ ID NO: 6568 - DNA, 14 bp, synthetic construct
  source 1..14: mol_type = other DNA
agttgccagagcgg

SEQ ID NO: 6569 - DNA, 14 bp, synthetic construct
  source 1..14: mol_type = other DNA
ctaccacggggtcc

SEQ ID NO: 6570 - DNA, 14 bp, synthetic construct
  source 1..14: mol_type = other DNA
tagtaagaaggcac

SEQ ID NO: 6571 - DNA, 14 bp, synthetic construct
  source 1..14: mol_type = other DNA
cgtaggacggctgg

SEQ ID NO: 6572 - DNA, 14 bp, synthetic construct
  source 1..14: mol_type = other DNA
agtcgtacccggcc

SEQ ID NO: 6573 - DNA, 14 bp, synthetic construct
  source 1..14: mol_type = other DNA
taccgcctggcacg

SEQ ID NO: 6574 - DNA, 14 bp, synthetic construct
  source 1..14: mol_type = other DNA
gttacacacggcgc

SEQ ID NO: 6575 - DNA, 14 bp, synthetic construct
  source 1..14: mol_type = other DNA
tgcataccgcgagc

SEQ ID NO: 6576 - DNA, 14 bp, synthetic construct
  source 1..14: mol_type = other DNA
tcaggcgagggtac

SEQ ID NO: 6577 - DNA, 14 bp, synthetic construct
  source 1..14: mol_type = other DNA
agcagtaccgtcag

SEQ ID NO: 6578 - DNA, 14 bp, synthetic construct
  source 1..14: mol_type = other DNA
cgggagcgataatc

SEQ ID NO: 6579 - DNA, 14 bp, synthetic construct
  source 1..14: mol_type = other DNA
ccggtaccgtaggg

SEQ ID NO: 6580 - DNA, 14 bp, synthetic construct
  source 1..14: mol_type = other DNA
tggaggatcacaag

SEQ ID NO: 6581 - DNA, 14 bp, synthetic construct
  source 1..14: mol_type = other DNA
aagccacggtatac

SEQ ID NO: 6582 - DNA, 14 bp, synthetic construct
  source 1..14: mol_type = other DNA
aaggctggagccct

SEQ ID NO: 6583 - DNA, 14 bp, synthetic construct
  source 1..14: mol_type = other DNA
agtacccgtgcgag

SEQ ID NO: 6584 - DNA, 14 bp, synthetic construct
  source 1..14: mol_type = other DNA
ggagcctacccgtc

SEQ ID NO: 6585 - DNA, 14 bp, synthetic construct
  source 1..14: mol_type = other DNA
aatcacgggtcaag

SEQ ID NO: 6586 - DNA, 14 bp, synthetic construct
  source 1..14: mol_type = other DNA
acagtacgagtggg

SEQ ID NO: 6587 - DNA, 14 bp, synthetic construct
  source 1..14: mol_type = other DNA
cgcgagacttaagc

SEQ ID NO: 6588 - DNA, 14 bp, synthetic construct
  source 1..14: mol_type = other DNA
gtagagacgcctgc

SEQ ID NO: 6589 - DNA, 14 bp, synthetic construct
  source 1..14: mol_type = other DNA
taagcgaaactggc

SEQ ID NO: 6590 - DNA, 14 bp, synthetic construct
  source 1..14: mol_type = other DNA
aaacccagattgca

SEQ ID NO: 6591 - DNA, 14 bp, synthetic construct
  source 1..14: mol_type = other DNA
atcgaatcgacaga

SEQ ID NO: 6592 - DNA, 14 bp, synthetic construct
  source 1..14: mol_type = other DNA
aaacgtagacgtag

SEQ ID NO: 6593 - DNA, 14 bp, synthetic construct
  source 1..14: mol_type = other DNA
taacggcactacag

SEQ ID NO: 6594 - DNA, 14 bp, synthetic construct
  source 1..14: mol_type = other DNA
cgatcacacggggt

SEQ ID NO: 6595 - DNA, 14 bp, synthetic construct
  source 1..14: mol_type = other DNA
aagctagggcgtga

SEQ ID NO: 6596 - DNA, 14 bp, synthetic construct
  source 1..14: mol_type = other DNA
gtaggtaaccgagc

SEQ ID NO: 6597 - DNA, 14 bp, synthetic construct
  source 1..14: mol_type = other DNA
ggtcaacgcctgcc

SEQ ID NO: 6598 - DNA, 14 bp, synthetic construct
  source 1..14: mol_type = other DNA
gatcacgtcagaca

SEQ ID NO: 6599 - DNA, 14 bp, synthetic construct
  source 1..14: mol_type = other DNA
cagcatgctgggcg

SEQ ID NO: 6600 - DNA, 14 bp, synthetic construct
  source 1..14: mol_type = other DNA
cgagctaacgatac

SEQ ID NO: 6601 - DNA, 14 bp, synthetic construct
  source 1..14: mol_type = other DNA
gctggaaacgtccg

SEQ ID NO: 6602 - DNA, 14 bp, synthetic construct
  source 1..14: mol_type = other DNA
gggtgaggtcagac

SEQ ID NO: 6603 - DNA, 14 bp, synthetic construct
  source 1..14: mol_type = other DNA
ggtctaccgcagag

SEQ ID NO: 6604 - DNA, 14 bp, synthetic construct
  source 1..14: mol_type = other DNA
ttgagcagccaaac

SEQ ID NO: 6605 - DNA, 14 bp, synthetic construct
  source 1..14: mol_type = other DNA
accccgagagtggt

SEQ ID NO: 6606 - DNA, 14 bp, synthetic construct
  source 1..14: mol_type = other DNA
gccccactacgtca

SEQ ID NO: 6607 - DNA, 14 bp, synthetic construct
  source 1..14: mol_type = other DNA
ctagaccgatgaca

SEQ ID NO: 6608 - DNA, 14 bp, synthetic construct
  source 1..14: mol_type = other DNA
agcatggaaggtga

SEQ ID NO: 6609 - DNA, 14 bp, synthetic construct
  source 1..14: mol_type = other DNA
tgcgccaatacaga

SEQ ID NO: 6610 - DNA, 14 bp, synthetic construct
  source 1..14: mol_type = other DNA
cgcccttcacggca

SEQ ID NO: 6611 - DNA, 14 bp, synthetic construct
  source 1..14: mol_type = other DNA
gtggtcgcggagcc

SEQ ID NO: 6612 - DNA, 14 bp, synthetic construct
  source 1..14: mol_type = other DNA
ggttgaccacaacc

SEQ ID NO: 6613 - DNA, 14 bp, synthetic construct
  source 1..14: mol_type = other DNA
aggagaagattgga

SEQ ID NO: 6614 - DNA, 14 bp, synthetic construct
  source 1..14: mol_type = other DNA
ctcgtcggcgaaac

SEQ ID NO: 6615 - DNA, 14 bp, synthetic construct
  source 1..14: mol_type = other DNA
cccatagtaccaca

SEQ ID NO: 6616 - DNA, 14 bp, synthetic construct
  source 1..14: mol_type = other DNA
aaaccgaggcttcg

SEQ ID NO: 6617 - DNA, 14 bp, synthetic construct
  source 1..14: mol_type = other DNA
cgcatcggggtgcg

SEQ ID NO: 6618 - DNA, 14 bp, synthetic construct
  source 1..14: mol_type = other DNA
gtccggacgcacct

SEQ ID NO: 6619 - DNA, 14 bp, synthetic construct
  source 1..14: mol_type = other DNA
aagaaggtcacgtg

SEQ ID NO: 6620 - DNA, 14 bp, synthetic construct
  source 1..14: mol_type = other DNA
cccggacaagtgta

SEQ ID NO: 6621 - DNA, 14 bp, synthetic construct
  source 1..14: mol_type = other DNA
gcgagctcaaccct

SEQ ID NO: 6622 - DNA, 14 bp, synthetic construct
  source 1..14: mol_type = other DNA
caagacgatcagat

SEQ ID NO: 6623 - DNA, 14 bp, synthetic construct
  source 1..14: mol_type = other DNA
taggaatggacgga

SEQ ID NO: 6624 - DNA, 14 bp, synthetic construct
  source 1..14: mol_type = other DNA
ccaactatggagac

SEQ ID NO: 6625 - DNA, 14 bp, synthetic construct
  source 1..14: mol_type = other DNA
tggaaaacacgcat

SEQ ID NO: 6626 - DNA, 14 bp, synthetic construct
  source 1..14: mol_type = other DNA
aaaacaagatacgt

SEQ ID NO: 6627 - DNA, 14 bp, synthetic construct
  source 1..14: mol_type = other DNA
taacgctggaagaa

SEQ ID NO: 6628 - DNA, 14 bp, synthetic construct
  source 1..14: mol_type = other DNA
gacgcgaatagatg

SEQ ID NO: 6629 - DNA, 14 bp, synthetic construct
  source 1..14: mol_type = other DNA
cagggcgattccga

SEQ ID NO: 6630 - DNA, 14 bp, synthetic construct
  source 1..14: mol_type = other DNA
tcacgcacgataaa

SEQ ID NO: 6631 - DNA, 14 bp, synthetic construct
  source 1..14: mol_type = other DNA
tatacagggggagc

SEQ ID NO: 6632 - DNA, 14 bp, synthetic construct
  source 1..14: mol_type = other DNA
cggtctccggaaaa

SEQ ID NO: 6633 - DNA, 14 bp, synthetic construct
  source 1..14: mol_type = other DNA
ggtcatagaccgca

SEQ ID NO: 6634 - DNA, 14 bp, synthetic construct
  source 1..14: mol_type = other DNA
ctcgggaggtccga

SEQ ID NO: 6635 - DNA, 14 bp, synthetic construct
  source 1..14: mol_type = other DNA
gtgaaggtggggcc

SEQ ID NO: 6636 - DNA, 14 bp, synthetic construct
  source 1..14: mol_type = other DNA
aactcgaggaactg

SEQ ID NO: 6637 - DNA, 14 bp, synthetic construct
  source 1..14: mol_type = other DNA
gtagggacggtccg

SEQ ID NO: 6638 - DNA, 14 bp, synthetic construct
  source 1..14: mol_type = other DNA
accaggccttggac

SEQ ID NO: 6639 - DNA, 14 bp, synthetic construct
  source 1..14: mol_type = other DNA
aactggtccgggac

SEQ ID NO: 6640 - DNA, 14 bp, synthetic construct
  source 1..14: mol_type = other DNA
aagatcggcgtacc

SEQ ID NO: 6641 - DNA, 14 bp, synthetic construct
  source 1..14: mol_type = other DNA
tcccgagcatcgac

SEQ ID NO: 6642 - DNA, 14 bp, synthetic construct
  source 1..14: mol_type = other DNA
ggccagtcagtgca

SEQ ID NO: 6643 - DNA, 14 bp, synthetic construct
  source 1..14: mol_type = other DNA
cgagaatcgtggca

SEQ ID NO: 6644 - DNA, 14 bp, synthetic construct
  source 1..14: mol_type = other DNA
ggaactagcgtaac

SEQ ID NO: 6645 - DNA, 14 bp, synthetic construct
  source 1..14: mol_type = other DNA
gaaactatgaaaca

SEQ ID NO: 6646 - DNA, 14 bp, synthetic construct
  source 1..14: mol_type = other DNA
tgaaaccctgaccc

SEQ ID NO: 6647 - DNA, 14 bp, synthetic construct
  source 1..14: mol_type = other DNA
cagagctgcccatg

SEQ ID NO: 6648 - DNA, 14 bp, synthetic construct
  source 1..14: mol_type = other DNA
accgggaatcggat

SEQ ID NO: 6649 - DNA, 14 bp, synthetic construct
  source 1..14: mol_type = other DNA
gctatcgcgaaggc

SEQ ID NO: 6650 - DNA, 14 bp, synthetic construct
  source 1..14: mol_type = other DNA
gacagataactgca

SEQ ID NO: 6651 - DNA, 14 bp, synthetic construct
  source 1..14: mol_type = other DNA
tgacaaagaagctg

SEQ ID NO: 6652 - DNA, 14 bp, synthetic construct
  source 1..14: mol_type = other DNA
ggaagagtcgtgag

SEQ ID NO: 6653 - DNA, 14 bp, synthetic construct
  source 1..14: mol_type = other DNA
ggcgctatgggaaa

SEQ ID NO: 6654 - DNA, 14 bp, synthetic construct
  source 1..14: mol_type = other DNA
gaaaccgacaatct

SEQ ID NO: 6655 - DNA, 14 bp, synthetic construct
  source 1..14: mol_type = other DNA
cccctctcacacag

SEQ ID NO: 6656 - DNA, 14 bp, synthetic construct
  source 1..14: mol_type = other DNA
ctaggacgaatgag

SEQ ID NO: 6657 - DNA, 14 bp, synthetic construct
  source 1..14: mol_type = other DNA
ggggtgaggacctg

SEQ ID NO: 6658 - DNA, 14 bp, synthetic construct
  source 1..14: mol_type = other DNA
cgtccagtgaccca

SEQ ID NO: 6659 - DNA, 14 bp, synthetic construct
  source 1..14: mol_type = other DNA
ggacgcggaaatat

SEQ ID NO: 6660 - DNA, 14 bp, synthetic construct
  source 1..14: mol_type = other DNA
agaaaagaccttgg

SEQ ID NO: 6661 - DNA, 14 bp, synthetic construct
  source 1..14: mol_type = other DNA
aaccgggtgaatga

SEQ ID NO: 6662 - DNA, 14 bp, synthetic construct
  source 1..14: mol_type = other DNA
cgcacggcctacgt

SEQ ID NO: 6663 - DNA, 14 bp, synthetic construct
  source 1..14: mol_type = other DNA
gaccacatggtgcc

SEQ ID NO: 6664 - DNA, 14 bp, synthetic construct
  source 1..14: mol_type = other DNA
cacgaacagttgcc

SEQ ID NO: 6665 - DNA, 14 bp, synthetic construct
  source 1..14: mol_type = other DNA
catctacaacagcc

SEQ ID NO: 6666 - DNA, 14 bp, synthetic construct
  source 1..14: mol_type = other DNA
gacataagtacggg

SEQ ID NO: 6667 - DNA, 14 bp, synthetic construct
  source 1..14: mol_type = other DNA
ctaaggacaagtgc

SEQ ID NO: 6668 - DNA, 14 bp, synthetic construct
  source 1..14: mol_type = other DNA
actcagcaacggta

SEQ ID NO: 6669 - DNA, 14 bp, synthetic construct
  source 1..14: mol_type = other DNA
ggcaccggtcgtcg

SEQ ID NO: 6670 - DNA, 14 bp, synthetic construct
  source 1..14: mol_type = other DNA
gttcagaagaggcg

SEQ ID NO: 6671 - DNA, 14 bp, synthetic construct
  source 1..14: mol_type = other DNA
tgacgctacggggg

SEQ ID NO: 6672 - DNA, 14 bp, synthetic construct
  source 1..14: mol_type = other DNA
tccgcgtcacggag

SEQ ID NO: 6673 - DNA, 14 bp, synthetic construct
  source 1..14: mol_type = other DNA
aagaactgcaccta

SEQ ID NO: 6674 - DNA, 14 bp, synthetic construct
  source 1..14: mol_type = other DNA
tacagccatgacaa

SEQ ID NO: 6675 - DNA, 14 bp, synthetic construct
  source 1..14: mol_type = other DNA
tgccctaagaaccc

SEQ ID NO: 6676 - DNA, 14 bp, synthetic construct
  source 1..14: mol_type = other DNA
cgagcactgagtac

SEQ ID NO: 6677 - DNA, 14 bp, synthetic construct
  source 1..14: mol_type = other DNA
cgctaaacactgac

SEQ ID NO: 6678 - DNA, 14 bp, synthetic construct
  source 1..14: mol_type = other DNA
ggctatggccgcgg

SEQ ID NO: 6679 - DNA, 14 bp, synthetic construct
  source 1..14: mol_type = other DNA
ttggcgcaagaaga

SEQ ID NO: 6680 - DNA, 14 bp, synthetic construct
  source 1..14: mol_type = other DNA
tctaccgccagacg

SEQ ID NO: 6681 - DNA, 14 bp, synthetic construct
  source 1..14: mol_type = other DNA
gctataaccagaac

SEQ ID NO: 6682 - DNA, 14 bp, synthetic construct
  source 1..14: mol_type = other DNA
taacgatccgcgcc

SEQ ID NO: 6683 - DNA, 14 bp, synthetic construct
  source 1..14: mol_type = other DNA
ccaaggcataacat

SEQ ID NO: 6684 - DNA, 14 bp, synthetic construct
  source 1..14: mol_type = other DNA
tgcccgtgcaacca

SEQ ID NO: 6685 - DNA, 14 bp, synthetic construct
  source 1..14: mol_type = other DNA
acatgctggcgaaa

SEQ ID NO: 6686 - DNA, 14 bp, synthetic construct
  source 1..14: mol_type = other DNA
atagggaataaaag

SEQ ID NO: 6687 - DNA, 14 bp, synthetic construct
  source 1..14: mol_type = other DNA
gggaatagtgaaaa

SEQ ID NO: 6688 - DNA, 14 bp, synthetic construct
  source 1..14: mol_type = other DNA
gcatcaccggcagt

SEQ ID NO: 6689 - DNA, 14 bp, synthetic construct
  source 1..14: mol_type = other DNA
aaaccgccgggctt

SEQ ID NO: 6690 - DNA, 14 bp, synthetic construct
  source 1..14: mol_type = other DNA
tgacacaatcacgc

SEQ ID NO: 6691 - DNA, 14 bp, synthetic construct
  source 1..14: mol_type = other DNA
taacggtggacccg

SEQ ID NO: 6692 - DNA, 14 bp, synthetic construct
  source 1..14: mol_type = other DNA
cgacaaaggtcagt

SEQ ID NO: 6693 - DNA, 14 bp, synthetic construct
  source 1..14: mol_type = other DNA
gagtcgagcacctc

SEQ ID NO: 6694 - DNA, 14 bp, synthetic construct
  source 1..14: mol_type = other DNA
agatggatacagca

SEQ ID NO: 6695 - DNA, 14 bp, synthetic construct
  source 1..14: mol_type = other DNA
gcaatgcccagagt

SEQ ID NO: 6696 - DNA, 14 bp, synthetic construct
  source 1..14: mol_type = other DNA
ctcacccacccggt

SEQ ID NO: 6697 - DNA, 14 bp, synthetic construct
  source 1..14: mol_type = other DNA
gcacatcctcacaa

SEQ ID NO: 6698 - DNA, 14 bp, synthetic construct
  source 1..14: mol_type = other DNA
gtctggaaagcccc

SEQ ID NO: 6699 - DNA, 14 bp, synthetic construct
  source 1..14: mol_type = other DNA
gaaaagtcggcaat

SEQ ID NO: 6700 - DNA, 14 bp, synthetic construct
  source 1..14: mol_type = other DNA
gtgtgaccggacga

SEQ ID NO: 6701 - DNA, 14 bp, synthetic construct
  source 1..14: mol_type = other DNA
ccggtgcacctgga

SEQ ID NO: 6702 - DNA, 14 bp, synthetic construct
  source 1..14: mol_type = other DNA
cgggacagaacctt

SEQ ID NO: 6703 - DNA, 14 bp, synthetic construct
  source 1..14: mol_type = other DNA
agtgtagccgccgg

SEQ ID NO: 6704 - DNA, 14 bp, synthetic construct
  source 1..14: mol_type = other DNA
ggtgccaccagtga

SEQ ID NO: 6705 - DNA, 14 bp, synthetic construct
  source 1..14: mol_type = other DNA
tcaggcccagacat

SEQ ID NO: 6706 - DNA, 14 bp, synthetic construct
  source 1..14: mol_type = other DNA
gggtccccagactg

SEQ ID NO: 6707 - DNA, 14 bp, synthetic construct
  source 1..14: mol_type = other DNA
actggggagcaatg

SEQ ID NO: 6708 - DNA, 14 bp, synthetic construct
  source 1..14: mol_type = other DNA
ccccgtcaatgcca

SEQ ID NO: 6709 - DNA, 14 bp, synthetic construct
  source 1..14: mol_type = other DNA
ggccctgtcgaacg

SEQ ID NO: 6710 - DNA, 14 bp, synthetic construct
  source 1..14: mol_type = other DNA
caacttgcggcggg

SEQ ID NO: 6711 - DNA, 14 bp, synthetic construct
  source 1..14: mol_type = other DNA
agtccacgacgtcc

SEQ ID NO: 6712 - DNA, 14 bp, synthetic construct
  source 1..14: mol_type = other DNA
acctcgaggtagaa

SEQ ID NO: 6713 - DNA, 14 bp, synthetic construct
  source 1..14: mol_type = other DNA
cctaaccggaaatc

SEQ ID NO: 6714 - DNA, 14 bp, synthetic construct
  source 1..14: mol_type = other DNA
cccagccgtgtcgc

SEQ ID NO: 6715 - DNA, 14 bp, synthetic construct
  source 1..14: mol_type = other DNA
ccggtcgatcgaga

SEQ ID NO: 6716 - DNA, 14 bp, synthetic construct
  source 1..14: mol_type = other DNA
cctatcgccgacga

SEQ ID NO: 6717 - DNA, 14 bp, synthetic construct
  source 1..14: mol_type = other DNA
ggcgtctgacgcga

SEQ ID NO: 6718 - DNA, 14 bp, synthetic construct
  source 1..14: mol_type = other DNA
gaactcgggactcc

SEQ ID NO: 6719 - DNA, 14 bp, synthetic construct
  source 1..14: mol_type = other DNA
gaagccgagcttac

SEQ ID NO: 6720 - DNA, 14 bp, synthetic construct
  source 1..14: mol_type = other DNA
gaatgcccgagaat

SEQ ID NO: 6721 - DNA, 14 bp, synthetic construct
  source 1..14: mol_type = other DNA
gggaacatgaacat

SEQ ID NO: 6722 - DNA, 14 bp, synthetic construct
  source 1..14: mol_type = other DNA
tgatcacggcaaga

SEQ ID NO: 6723 - DNA, 14 bp, synthetic construct
  source 1..14: mol_type = other DNA
cccatcccctaaac

SEQ ID NO: 6724 - DNA, 14 bp, synthetic construct
  source 1..14: mol_type = other DNA
ggaatcggaggtcc

SEQ ID NO: 6725 - DNA, 14 bp, synthetic construct
  source 1..14: mol_type = other DNA
tacataagaggaac

SEQ ID NO: 6726 - DNA, 14 bp, synthetic construct
  source 1..14: mol_type = other DNA
aaactcatcaccgg

SEQ ID NO: 6727 - DNA, 14 bp, synthetic construct
  source 1..14: mol_type = other DNA
cccggtacaatgac

SEQ ID NO: 6728 - DNA, 14 bp, synthetic construct
  source 1..14: mol_type = other DNA
ggctacccgctcgc

SEQ ID NO: 6729 - DNA, 14 bp, synthetic construct
  source 1..14: mol_type = other DNA
actcagcgaaactg

SEQ ID NO: 6730 - DNA, 14 bp, synthetic construct
  source 1..14: mol_type = other DNA
actgtcacggggga

SEQ ID NO: 6731 - DNA, 14 bp, synthetic construct
  source 1..14: mol_type = other DNA
aaggctgcgtgaaa

SEQ ID NO: 6732 - DNA, 14 bp, synthetic construct
  source 1..14: mol_type = other DNA
agtctaagacacca

SEQ ID NO: 6733 - DNA, 14 bp, synthetic construct
  source 1..14: mol_type = other DNA
atctggagggagcc

SEQ ID NO: 6734 - DNA, 14 bp, synthetic construct
  source 1..14: mol_type = other DNA
ccggagacattgaa

SEQ ID NO: 6735 - DNA, 14 bp, synthetic construct
  source 1..14: mol_type = other DNA
ggagacccattcac

SEQ ID NO: 6736 - DNA, 14 bp, synthetic construct
  source 1..14: mol_type = other DNA
catcgtcggaaccc

SEQ ID NO: 6737 - DNA, 14 bp, synthetic construct
  source 1..14: mol_type = other DNA
aaaataggtgcgaa

SEQ ID NO: 6738 - DNA, 14 bp, synthetic construct
  source 1..14: mol_type = other DNA
aaaaccagatctag

SEQ ID NO: 6739 - DNA, 14 bp, synthetic construct
  source 1..14: mol_type = other DNA
cgcacctgaaggat

SEQ ID NO: 6740 - DNA, 14 bp, synthetic construct
  source 1..14: mol_type = other DNA
tactaccaccgggc

SEQ ID NO: 6741 - DNA, 14 bp, synthetic construct
  source 1..14: mol_type = other DNA
tctccgccaaagca

SEQ ID NO: 6742 - DNA, 14 bp, synthetic construct
  source 1..14: mol_type = other DNA
taccaccgaatacc

SEQ ID NO: 6743 - DNA, 14 bp, synthetic construct
  source 1..14: mol_type = other DNA
cgcggatagacatc

SEQ ID NO: 6744 - DNA, 14 bp, synthetic construct
  source 1..14: mol_type = other DNA
aagagtcaagtgcg

SEQ ID NO: 6745 - DNA, 14 bp, synthetic construct
  source 1..14: mol_type = other DNA
aaagagattacacg

SEQ ID NO: 6746 - DNA, 14 bp, synthetic construct
  source 1..14: mol_type = other DNA
gcagaccacgctat

SEQ ID NO: 6747 - DNA, 14 bp, synthetic construct
  source 1..14: mol_type = other DNA
cacgctgtgcggac

SEQ ID NO: 6748 - DNA, 14 bp, synthetic construct
  source 1..14: mol_type = other DNA
cctcggagacctcg

SEQ ID NO: 6749 - DNA, 14 bp, synthetic construct
  source 1..14: mol_type = other DNA
aggggagcattaac

SEQ ID NO: 6750 - DNA, 14 bp, synthetic construct
  source 1..14: mol_type = other DNA
gcattggacggggg

SEQ ID NO: 6751 - DNA, 14 bp, synthetic construct
  source 1..14: mol_type = other DNA
tgaaaagaacagtc

SEQ ID NO: 6752 - DNA, 14 bp, synthetic construct
  source 1..14: mol_type = other DNA
cccaccacccgtct

SEQ ID NO: 6753 - DNA, 14 bp, synthetic construct
  source 1..14: mol_type = other DNA
tgaccgggtcagca

SEQ ID NO: 6754 - DNA, 14 bp, synthetic construct
  source 1..14: mol_type = other DNA
cacttaaacgcaaa

SEQ ID NO: 6755 - DNA, 14 bp, synthetic construct
  source 1..14: mol_type = other DNA
ctccctgccaccaa

SEQ ID NO: 6756 - DNA, 14 bp, synthetic construct
  source 1..14: mol_type = other DNA
cgcaggtccatggc

SEQ ID NO: 6757 - DNA, 14 bp, synthetic construct
  source 1..14: mol_type = other DNA
ggtgtgagagcggg

SEQ ID NO: 6758 - DNA, 14 bp, synthetic construct
  source 1..14: mol_type = other DNA
tgagaaggcgcctg

SEQ ID NO: 6759 - DNA, 14 bp, synthetic construct
  source 1..14: mol_type = other DNA
gcataatggccgag

SEQ ID NO: 6760 - DNA, 14 bp, synthetic construct
  source 1..14: mol_type = other DNA
actgccggtgggca

SEQ ID NO: 6761 - DNA, 14 bp, synthetic construct
  source 1..14: mol_type = other DNA
gagcaacgggggtt

SEQ ID NO: 6762 - DNA, 14 bp, synthetic construct
  source 1..14: mol_type = other DNA
gagtccactggagg

SEQ ID NO: 6763 - DNA, 14 bp, synthetic construct
  source 1..14: mol_type = other DNA
ccagttccccaaaa

SEQ ID NO: 6764 - DNA, 14 bp, synthetic construct
  source 1..14: mol_type = other DNA
cgaaaggcatcagt

SEQ ID NO: 6765 - DNA, 14 bp, synthetic construct
  source 1..14: mol_type = other DNA
aactagacaaagct

SEQ ID NO: 6766 - DNA, 14 bp, synthetic construct
  source 1..14: mol_type = other DNA
aaaaacctcgctcc

SEQ ID NO: 6767 - DNA, 14 bp, synthetic construct
  source 1..14: mol_type = other DNA
gccgtagatggagg

SEQ ID NO: 6768 - DNA, 14 bp, synthetic construct
  source 1..14: mol_type = other DNA
ctaccgataaaagg

SEQ ID NO: 6769 - DNA, 14 bp, synthetic construct
  source 1..14: mol_type = other DNA
gaactgatgagagg

SEQ ID NO: 6770 - DNA, 14 bp, synthetic construct
  source 1..14: mol_type = other DNA
gaatactccaacac

SEQ ID NO: 6771 - DNA, 14 bp, synthetic construct
  source 1..14: mol_type = other DNA
gacatagataaaca

SEQ ID NO: 6772 - DNA, 14 bp, synthetic construct
  source 1..14: mol_type = other DNA
aagccggttaggcg

SEQ ID NO: 6773 - DNA, 14 bp, synthetic construct
  source 1..14: mol_type = other DNA
gccatccagcggtg

SEQ ID NO: 6774 - DNA, 14 bp, synthetic construct
  source 1..14: mol_type = other DNA
acgtgcgacctggg

SEQ ID NO: 6775 - DNA, 14 bp, synthetic construct
  source 1..14: mol_type = other DNA
aaccctcgaggtgg

SEQ ID NO: 6776 - DNA, 14 bp, synthetic construct
  source 1..14: mol_type = other DNA
aggccaccgctcat

SEQ ID NO: 6777 - DNA, 14 bp, synthetic construct
  source 1..14: mol_type = other DNA
aacacgcattaaac

SEQ ID NO: 6778 - DNA, 14 bp, synthetic construct
  source 1..14: mol_type = other DNA
cccccatcaacggt

SEQ ID NO: 6779 - DNA, 14 bp, synthetic construct
  source 1..14: mol_type = other DNA
tcatagccagggaa

SEQ ID NO: 6780 - DNA, 14 bp, synthetic construct
  source 1..14: mol_type = other DNA
agttagggccgcca

SEQ ID NO: 6781 - DNA, 14 bp, synthetic construct
  source 1..14: mol_type = other DNA
cggaatgaatggac

SEQ ID NO: 6782 - DNA, 14 bp, synthetic construct
  source 1..14: mol_type = other DNA
cgaatagggcgaat

SEQ ID NO: 6783 - DNA, 14 bp, synthetic construct
  source 1..14: mol_type = other DNA
attgagaacgccga

SEQ ID NO: 6784 - DNA, 14 bp, synthetic construct
  source 1..14: mol_type = other DNA
taatccaagaacgc

SEQ ID NO: 6785 - DNA, 14 bp, synthetic construct
  source 1..14: mol_type = other DNA
cagggccttaagca

SEQ ID NO: 6786 - DNA, 14 bp, synthetic construct
  source 1..14: mol_type = other DNA
tgaggtaccgggac

SEQ ID NO: 6787 - DNA, 14 bp, synthetic construct
  source 1..14: mol_type = other DNA
aaaggcttgccgaa

SEQ ID NO: 6788 - DNA, 14 bp, synthetic construct
  source 1..14: mol_type = other DNA
tggccacggctacg

SEQ ID NO: 6789 - DNA, 14 bp, synthetic construct
  source 1..14: mol_type = other DNA
aatcgtgcgggaga

SEQ ID NO: 6790 - DNA, 14 bp, synthetic construct
  source 1..14: mol_type = other DNA
aggggaagctactg

SEQ ID NO: 6791 - DNA, 14 bp, synthetic construct
  source 1..14: mol_type = other DNA
gtctcggggaggac

SEQ ID NO: 6792 - DNA, 14 bp, synthetic construct
  source 1..14: mol_type = other DNA
atcagtgggggccg

SEQ ID NO: 6793 - DNA, 14 bp, synthetic construct
  source 1..14: mol_type = other DNA
cccctgggagagct

SEQ ID NO: 6794 - DNA, 14 bp, synthetic construct
  source 1..14: mol_type = other DNA
acaatacaatggac

SEQ ID NO: 6795 - DNA, 14 bp, synthetic construct
  source 1..14: mol_type = other DNA
ggtccgcactgcac

SEQ ID NO: 6796 - DNA, 14 bp, synthetic construct
  source 1..14: mol_type = other DNA
ggttgcgacgcgcg

SEQ ID NO: 6797 - DNA, 14 bp, synthetic construct
  source 1..14: mol_type = other DNA
cctcggcaggtcaa

SEQ ID NO: 6798 - DNA, 14 bp, synthetic construct
  source 1..14: mol_type = other DNA
tgcgtgccccacac

SEQ ID NO: 6799 - DNA, 14 bp, synthetic construct
  source 1..14: mol_type = other DNA
tcggagtgacaacc

SEQ ID NO: 6800 - DNA, 14 bp, synthetic construct
  source 1..14: mol_type = other DNA
tggcgcaacacgct

SEQ ID NO: 6801 - DNA, 14 bp, synthetic construct
  source 1..14: mol_type = other DNA
ataaacaacgataa

SEQ ID NO: 6802 - DNA, 14 bp, synthetic construct
  source 1..14: mol_type = other DNA
cacgtccccataca

SEQ ID NO: 6803 - DNA, 14 bp, synthetic construct
  source 1..14: mol_type = other DNA
actcggacggacta

SEQ ID NO: 6804 - DNA, 14 bp, synthetic construct
  source 1..14: mol_type = other DNA
ccttgacgaaaaac

SEQ ID NO: 6805 - DNA, 14 bp, synthetic construct
  source 1..14: mol_type = other DNA
gccgtgatcggccg

SEQ ID NO: 6806 - DNA, 14 bp, synthetic construct
  source 1..14: mol_type = other DNA
aataaccaagtcgg

SEQ ID NO: 6807 - DNA, 14 bp, synthetic construct
  source 1..14: mol_type = other DNA
ccctgcgtaggcac

SEQ ID NO: 6808 - DNA, 14 bp, synthetic construct
  source 1..14: mol_type = other DNA
ctaggacagcgggt

SEQ ID NO: 6809 - DNA, 14 bp, synthetic construct
  source 1..14: mol_type = other DNA
agccggttaggcca

SEQ ID NO: 6810 - DNA, 14 bp, synthetic construct
  source 1..14: mol_type = other DNA
aactatgggcggca

SEQ ID NO: 6811 - DNA, 14 bp, synthetic construct
  source 1..14: mol_type = other DNA
atgaggaaagggct

SEQ ID NO: 6812 - DNA, 14 bp, synthetic construct
  source 1..14: mol_type = other DNA
cgatagatgcgaca

SEQ ID NO: 6813 - DNA, 14 bp, synthetic construct
  source 1..14: mol_type = other DNA
ctgaacactacccc

SEQ ID NO: 6814 - DNA, 14 bp, synthetic construct
  source 1..14: mol_type = other DNA
tgaaacacggtgaa

SEQ ID NO: 6815 - DNA, 14 bp, synthetic construct
  source 1..14: mol_type = other DNA
aatatggaaccagc

SEQ ID NO: 6816 - DNA, 14 bp, synthetic construct
  source 1..14: mol_type = other DNA
cagtaaggaaggtc

SEQ ID NO: 6817 - DNA, 14 bp, synthetic construct
  source 1..14: mol_type = other DNA
taacccggtccgag

SEQ ID NO: 6818 - DNA, 14 bp, synthetic construct
  source 1..14: mol_type = other DNA
ctgccgtacgggcc

SEQ ID NO: 6819 - DNA, 14 bp, synthetic construct
  source 1..14: mol_type = other DNA
gtgaggacgggtaa

SEQ ID NO: 6820 - DNA, 14 bp, synthetic construct
  source 1..14: mol_type = other DNA
cagcctcagcagat

SEQ ID NO: 6821 - DNA, 14 bp, synthetic construct
  source 1..14: mol_type = other DNA
cactcagcctccgc

SEQ ID NO: 6822 - DNA, 14 bp, synthetic construct
  source 1..14: mol_type = other DNA
tgaaaaggtacgac

SEQ ID NO: 6823 - DNA, 14 bp, synthetic construct
  source 1..14: mol_type = other DNA
gggtccccactgga

SEQ ID NO: 6824 - DNA, 14 bp, synthetic construct
  source 1..14: mol_type = other DNA
cacaacgcgcatgt

SEQ ID NO: 6825 - DNA, 14 bp, synthetic construct
  source 1..14: mol_type = other DNA
acgatggcgcgcta

SEQ ID NO: 6826 - DNA, 14 bp, synthetic construct
  source 1..14: mol_type = other DNA
gtagcgtagacgcg

SEQ ID NO: 6827 - DNA, 14 bp, synthetic construct
  source 1..14: mol_type = other DNA
ccaccacagataat

SEQ ID NO: 6828 - DNA, 14 bp, synthetic construct
  source 1..14: mol_type = other DNA
cgacgtggtagaaa

SEQ ID NO: 6829 - DNA, 14 bp, synthetic construct
  source 1..14: mol_type = other DNA
gcgcacgcatgctg

SEQ ID NO: 6830 - DNA, 14 bp, synthetic construct
  source 1..14: mol_type = other DNA
cgttagcggcagcc

SEQ ID NO: 6831 - DNA, 14 bp, synthetic construct
  source 1..14: mol_type = other DNA
taggatcgccacca

SEQ ID NO: 6832 - DNA, 14 bp, synthetic construct
  source 1..14: mol_type = other DNA
tcagcccgacctcg

SEQ ID NO: 6833 - DNA, 14 bp, synthetic construct
  source 1..14: mol_type = other DNA
cgaaacgagttcgg

SEQ ID NO: 6834 - DNA, 14 bp, synthetic construct
  source 1..14: mol_type = other DNA
ccccgtcctccaac

SEQ ID NO: 6835 - DNA, 14 bp, synthetic construct
  source 1..14: mol_type = other DNA
ggtgacgtgaaacc

SEQ ID NO: 6836 - DNA, 14 bp, synthetic construct
  source 1..14: mol_type = other DNA
atctacacaaggac

SEQ ID NO: 6837 - DNA, 14 bp, synthetic construct
  source 1..14: mol_type = other DNA
agcgaaatgtcggg

SEQ ID NO: 6838 - DNA, 14 bp, synthetic construct
  source 1..14: mol_type = other DNA
tctgccgataacag

SEQ ID NO: 6839 - DNA, 14 bp, synthetic construct
  source 1..14: mol_type = other DNA
gagcaatctgctgg

SEQ ID NO: 6840 - DNA, 14 bp, synthetic construct
  source 1..14: mol_type = other DNA
acctgtatcaaggc

SEQ ID NO: 6841 - DNA, 14 bp, synthetic construct
  source 1..14: mol_type = other DNA
actttgaccccgaa

SEQ ID NO: 6842 - DNA, 14 bp, synthetic construct
  source 1..14: mol_type = other DNA
tcggccagatggtg

SEQ ID NO: 6843 - DNA, 14 bp, synthetic construct
  source 1..14: mol_type = other DNA
tcctgataaaggga

SEQ ID NO: 6844 - DNA, 14 bp, synthetic construct
  source 1..14: mol_type = other DNA
acgaggcagtcttc

SEQ ID NO: 6845 - DNA, 14 bp, synthetic construct
  source 1..14: mol_type = other DNA
aacgattggctaga

SEQ ID NO: 6846 - DNA, 14 bp, synthetic construct
  source 1..14: mol_type = other DNA
tagctgcccatgaa

SEQ ID NO: 6847 - DNA, 14 bp, synthetic construct
  source 1..14: mol_type = other DNA
tagcaaatctcccg

SEQ ID NO: 6848 - DNA, 14 bp, synthetic construct
  source 1..14: mol_type = other DNA
agtagcattcgacg

SEQ ID NO: 6849 - DNA, 14 bp, synthetic construct
  source 1..14: mol_type = other DNA
agctggtacaatag

SEQ ID NO: 6850 - DNA, 14 bp, synthetic construct
  source 1..14: mol_type = other DNA
tcgcattagcgggc

SEQ ID NO: 6851 - DNA, 14 bp, synthetic construct
  source 1..14: mol_type = other DNA
gaaggatttgaagg

SEQ ID NO: 6852 - DNA, 14 bp, synthetic construct
  source 1..14: mol_type = other DNA
ccgctcgggtagtg

SEQ ID NO: 6853 - DNA, 14 bp, synthetic construct
  source 1..14: mol_type = other DNA
tctccaacaataac

SEQ ID NO: 6854 - DNA, 14 bp, synthetic construct
  source 1..14: mol_type = other DNA
ggatgtgcggtcca

SEQ ID NO: 6855 - DNA, 14 bp, synthetic construct
  source 1..14: mol_type = other DNA
aaagagtacaactt

SEQ ID NO: 6856 - DNA, 14 bp, synthetic construct
  source 1..14: mol_type = other DNA
gcttatacacgagg

SEQ ID NO: 6857 - DNA, 14 bp, synthetic construct
  source 1..14: mol_type = other DNA
agatcaactagaat

SEQ ID NO: 6858 - DNA, 14 bp, synthetic construct
  source 1..14: mol_type = other DNA
cgtgcttgcgcaaa

SEQ ID NO: 6859 - DNA, 14 bp, synthetic construct
  source 1..14: mol_type = other DNA
ctcaagtgccccta

SEQ ID NO: 6860 - DNA, 14 bp, synthetic construct
  source 1..14: mol_type = other DNA
gtgcaacgcttggg

SEQ ID NO: 6861 - DNA, 14 bp, synthetic construct
  source 1..14: mol_type = other DNA
tcccacagcattga

SEQ ID NO: 6862 - DNA, 14 bp, synthetic construct
  source 1..14: mol_type = other DNA
gaatagacgattca

SEQ ID NO: 6863 - DNA, 14 bp, synthetic construct
  source 1..14: mol_type = other DNA
atgcccagcattag

SEQ ID NO: 6864 - DNA, 14 bp, synthetic construct
  source 1..14: mol_type = other DNA
ctaagtcggaatcg

SEQ ID NO: 6865 - DNA, 14 bp, synthetic construct
  source 1..14: mol_type = other DNA
tccagttaacccgg

SEQ ID NO: 6866 - DNA, 14 bp, synthetic construct
  source 1..14: mol_type = other DNA
ataggagcgaatat

SEQ ID NO: 6867 - DNA, 14 bp, synthetic construct
  source 1..14: mol_type = other DNA
tcgccgtgcctgga

SEQ ID NO: 6868 - DNA, 14 bp, synthetic construct
  source 1..14: mol_type = other DNA
caccgtccggttga

SEQ ID NO: 6869 - DNA, 14 bp, synthetic construct
  source 1..14: mol_type = other DNA
gttctcgaccaacg

SEQ ID NO: 6870 - DNA, 14 bp, synthetic construct
  source 1..14: mol_type = other DNA
ctaatccaaccgtc

SEQ ID NO: 6871 - DNA, 14 bp, synthetic construct
  source 1..14: mol_type = other DNA
aaataacatgcact

SEQ ID NO: 6872 - DNA, 14 bp, synthetic construct
  source 1..14: mol_type = other DNA
ggataggggttaaa

SEQ ID NO: 6873 - DNA, 14 bp, synthetic construct
  source 1..14: mol_type = other DNA
caccttgagaatac

SEQ ID NO: 6874 - DNA, 14 bp, synthetic construct
  source 1..14: mol_type = other DNA
tggactaactcgca

SEQ ID NO: 6875 - DNA, 14 bp, synthetic construct
  source 1..14: mol_type = other DNA
gcgagttgtgcgca

SEQ ID NO: 6876 - DNA, 14 bp, synthetic construct
  source 1..14: mol_type = other DNA
ggccatcgtgggat

SEQ ID NO: 6877 - DNA, 14 bp, synthetic construct
  source 1..14: mol_type = other DNA
gctgagaattgagg

SEQ ID NO: 6878 - DNA, 14 bp, synthetic construct
  source 1..14: mol_type = other DNA
gcagatttaagacg

SEQ ID NO: 6879 - DNA, 14 bp, synthetic construct
  source 1..14: mol_type = other DNA
agacattcaagtgg

SEQ ID NO: 6880 - DNA, 14 bp, synthetic construct
  source 1..14: mol_type = other DNA
taacttgaccagca

SEQ ID NO: 6881 - DNA, 14 bp, synthetic construct
  source 1..14: mol_type = other DNA
agaatatccctgga

SEQ ID NO: 6882 - DNA, 14 bp, synthetic construct
  source 1..14: mol_type = other DNA
ccacaacctactct

SEQ ID NO: 6883 - DNA, 14 bp, synthetic construct
  source 1..14: mol_type = other DNA
attcgccctaacag

SEQ ID NO: 6884 - DNA, 14 bp, synthetic construct
  source 1..14: mol_type = other DNA
ggatgccacatcat

SEQ ID NO: 6885 - DNA, 14 bp, synthetic construct
  source 1..14: mol_type = other DNA
agagtaaatcacgt

SEQ ID NO: 6886 - DNA, 14 bp, synthetic construct
  source 1..14: mol_type = other DNA
atagtgtcaagggg

SEQ ID NO: 6887 - DNA, 14 bp, synthetic construct
  source 1..14: mol_type = other DNA
gacttcggaagatc

SEQ ID NO: 6888 - DNA, 14 bp, synthetic construct
  source 1..14: mol_type = other DNA
catctaacgcatga

SEQ ID NO: 6889 - DNA, 14 bp, synthetic construct
  source 1..14: mol_type = other DNA
taactagcaccagt

SEQ ID NO: 6890 - DNA, 14 bp, synthetic construct
  source 1..14: mol_type = other DNA
ctaagcaccgcttc

SEQ ID NO: 6891 - DNA, 14 bp, synthetic construct
  source 1..14: mol_type = other DNA
acagactgataggt

SEQ ID NO: 6892 - DNA, 14 bp, synthetic construct
  source 1..14: mol_type = other DNA
aagtcagctcctaa

SEQ ID NO: 6893 - DNA, 14 bp, synthetic construct
  source 1..14: mol_type = other DNA
gactcccacacatt

SEQ ID NO: 6894 - DNA, 14 bp, synthetic construct
  source 1..14: mol_type = other DNA
gtacatgtaccgaa

SEQ ID NO: 6895 - DNA, 14 bp, synthetic construct
  source 1..14: mol_type = other DNA
ggtcggctagtaca

SEQ ID NO: 6896 - DNA, 14 bp, synthetic construct
  source 1..14: mol_type = other DNA
tgatgcggacggat

SEQ ID NO: 6897 - DNA, 14 bp, synthetic construct
  source 1..14: mol_type = other DNA
aaacaagtaactct

SEQ ID NO: 6898 - DNA, 14 bp, synthetic construct
  source 1..14: mol_type = other DNA
aaatttccgacagc

SEQ ID NO: 6899 - DNA, 14 bp, synthetic construct
  source 1..14: mol_type = other DNA
gaattgataggccc

SEQ ID NO: 6900 - DNA, 14 bp, synthetic construct
  source 1..14: mol_type = other DNA
caacacaatggatt

SEQ ID NO: 6901 - DNA, 14 bp, synthetic construct
  source 1..14: mol_type = other DNA
cacttggaacgtac

SEQ ID NO: 6902 - DNA, 14 bp, synthetic construct
  source 1..14: mol_type = other DNA
gagttgacctaccc

SEQ ID NO: 6903 - DNA, 14 bp, synthetic construct
  source 1..14: mol_type = other DNA
gggccaccttatgc

SEQ ID NO: 6904 - DNA, 14 bp, synthetic construct
  source 1..14: mol_type = other DNA
ttgaccaaaatggg

SEQ ID NO: 6905 - DNA, 14 bp, synthetic construct
  source 1..14: mol_type = other DNA
acggtgcgataaat

SEQ ID NO: 6906 - DNA, 14 bp, synthetic construct
  source 1..14: mol_type = other DNA
cagtgcataggggt

SEQ ID NO: 6907 - DNA, 14 bp, synthetic construct
  source 1..14: mol_type = other DNA
ggcacggtgctcat

SEQ ID NO: 6908 - DNA, 14 bp, synthetic construct
  source 1..14: mol_type = other DNA
cagtgaagtccctg

SEQ ID NO: 6909 - DNA, 14 bp, synthetic construct
  source 1..14: mol_type = other DNA
ttccggtgcaaaag

SEQ ID NO: 6910 - DNA, 14 bp, synthetic construct
  source 1..14: mol_type = other DNA
gcgtctggacaact

SEQ ID NO: 6911 - DNA, 14 bp, synthetic construct
  source 1..14: mol_type = other DNA
cggaccatcgggtt

SEQ ID NO: 6912 - DNA, 14 bp, synthetic construct
  source 1..14: mol_type = other DNA
catttcagccgcac

SEQ ID NO: 6913 - DNA, 14 bp, synthetic construct
  source 1..14: mol_type = other DNA
catcgcgctgatga

SEQ ID NO: 6914 - DNA, 14 bp, synthetic construct
  source 1..14: mol_type = other DNA
gtgatggccacggt

SEQ ID NO: 6915 - DNA, 14 bp, synthetic construct
  source 1..14: mol_type = other DNA
gatacgcgtgctca

SEQ ID NO: 6916 - DNA, 14 bp, synthetic construct
  source 1..14: mol_type = other DNA
tctggtaggcccgc

SEQ ID NO: 6917 - DNA, 14 bp, synthetic construct
  source 1..14: mol_type = other DNA
tctaagaaaatcgc

SEQ ID NO: 6918 - DNA, 14 bp, synthetic construct
  source 1..14: mol_type = other DNA
cggacggaggttct

SEQ ID NO: 6919 - DNA, 14 bp, synthetic construct
  source 1..14: mol_type = other DNA
ggctcacctcgtgg

SEQ ID NO: 6920 - DNA, 14 bp, synthetic construct
  source 1..14: mol_type = other DNA
gatgtcatcaaagg

SEQ ID NO: 6921 - DNA, 14 bp, synthetic construct
  source 1..14: mol_type = other DNA
atacgtccagaagt

SEQ ID NO: 6922 - DNA, 14 bp, synthetic construct
  source 1..14: mol_type = other DNA
cgcagcttagccta

SEQ ID NO: 6923 - DNA, 14 bp, synthetic construct
  source 1..14: mol_type = other DNA
acgtagggtagata

SEQ ID NO: 6924 - DNA, 14 bp, synthetic construct
  source 1..14: mol_type = other DNA
tgggaacgtcaggt

SEQ ID NO: 6925 - DNA, 14 bp, synthetic construct
  source 1..14: mol_type = other DNA
gtgggcgtgcaatc

SEQ ID NO: 6926 - DNA, 14 bp, synthetic construct
  source 1..14: mol_type = other DNA
acgccacttagcta

SEQ ID NO: 6927 - DNA, 14 bp, synthetic construct
  source 1..14: mol_type = other DNA
gcccttgcaacgta

SEQ ID NO: 6928 - DNA, 14 bp, synthetic construct
  source 1..14: mol_type = other DNA
cttaccacctagcc

SEQ ID NO: 6929 - DNA, 14 bp, synthetic construct
  source 1..14: mol_type = other DNA
gtctgctagccaac

SEQ ID NO: 6930 - DNA, 14 bp, synthetic construct
  source 1..14: mol_type = other DNA
cggcgtccctgtaa

SEQ ID NO: 6931 - DNA, 14 bp, synthetic construct
  source 1..14: mol_type = other DNA
cgcctgactgccat

SEQ ID NO: 6932 - DNA, 14 bp, synthetic construct
  source 1..14: mol_type = other DNA
ggagggtcaaactt

SEQ ID NO: 6933 - DNA, 14 bp, synthetic construct
  source 1..14: mol_type = other DNA
accgattctggccg

SEQ ID NO: 6934 - DNA, 14 bp, synthetic construct
  source 1..14: mol_type = other DNA
actcgcacattcga

SEQ ID NO: 6935 - DNA, 14 bp, synthetic construct
  source 1..14: mol_type = other DNA
ccgcctagctaaat

SEQ ID NO: 6936 - DNA, 14 bp, synthetic construct
  source 1..14: mol_type = other DNA
tgtctccacacaag

SEQ ID NO: 6937 - DNA, 14 bp, synthetic construct
  source 1..14: mol_type = other DNA
gcgtgctgcactag

SEQ ID NO: 6938 - DNA, 14 bp, synthetic construct
  source 1..14: mol_type = other DNA
cattaacacacatg

SEQ ID NO: 6939 - DNA, 14 bp, synthetic construct
  source 1..14: mol_type = other DNA
aggcccttaatgca

SEQ ID NO: 6940 - DNA, 14 bp, synthetic construct
  source 1..14: mol_type = other DNA
ctgcacgcactaat

SEQ ID NO: 6941 - DNA, 14 bp, synthetic construct
  source 1..14: mol_type = other DNA
tcgaaatgcggtag

SEQ ID NO: 6942 - DNA, 14 bp, synthetic construct
  source 1..14: mol_type = other DNA
cccagacctgcctt

SEQ ID NO: 6943 - DNA, 14 bp, synthetic construct
  source 1..14: mol_type = other DNA
tgatatcgacaggg

SEQ ID NO: 6944 - DNA, 14 bp, synthetic construct
  source 1..14: mol_type = other DNA
tgtacaacgcactc

SEQ ID NO: 6945 - DNA, 14 bp, synthetic construct
  source 1..14: mol_type = other DNA
atcatgatcagcaa

SEQ ID NO: 6946 - DNA, 14 bp, synthetic construct
  source 1..14: mol_type = other DNA
tgctgactcggcgg

SEQ ID NO: 6947 - DNA, 14 bp, synthetic construct
  source 1..14: mol_type = other DNA
acacctggtccatc

SEQ ID NO: 6948 - DNA, 14 bp, synthetic construct
  source 1..14: mol_type = other DNA
ttaaggcaaaaatc

SEQ ID NO: 6949 - DNA, 14 bp, synthetic construct
  source 1..14: mol_type = other DNA
aatgttacgcggac

SEQ ID NO: 6950 - DNA, 14 bp, synthetic construct
  source 1..14: mol_type = other DNA
taagattacggcac

SEQ ID NO: 6951 - DNA, 14 bp, synthetic construct
  source 1..14: mol_type = other DNA
cagaaagattatac

SEQ ID NO: 6952 - DNA, 14 bp, synthetic construct
  source 1..14: mol_type = other DNA
ggattagataaggc

SEQ ID NO: 6953 - DNA, 14 bp, synthetic construct
  source 1..14: mol_type = other DNA
gcttcgggtccggg

SEQ ID NO: 6954 - DNA, 14 bp, synthetic construct
  source 1..14: mol_type = other DNA
cgtactgctacagg

SEQ ID NO: 6955 - DNA, 14 bp, synthetic construct
  source 1..14: mol_type = other DNA
atggcctggaaata

SEQ ID NO: 6956 - DNA, 14 bp, synthetic construct
  source 1..14: mol_type = other DNA
tgacggaattaaac

SEQ ID NO: 6957 - DNA, 14 bp, synthetic construct
  source 1..14: mol_type = other DNA
agccgtagcttaaa

SEQ ID NO: 6958 - DNA, 14 bp, synthetic construct
  source 1..14: mol_type = other DNA
aagtccgtcgcatc

SEQ ID NO: 6959 - DNA, 14 bp, synthetic construct
  source 1..14: mol_type = other DNA
tgccgagttcgaac

SEQ ID NO: 6960 - DNA, 14 bp, synthetic construct
  source 1..14: mol_type = other DNA
aggcctcagattga

SEQ ID NO: 6961 - DNA, 14 bp, synthetic construct
  source 1..14: mol_type = other DNA
aaagtcgatggagt

SEQ ID NO: 6962 - DNA, 14 bp, synthetic construct
  source 1..14: mol_type = other DNA
ggcctacttagaga

SEQ ID NO: 6963 - DNA, 14 bp, synthetic construct
  source 1..14: mol_type = other DNA
gcatctaatcaggg

SEQ ID NO: 6964 - DNA, 14 bp, synthetic construct
  source 1..14: mol_type = other DNA
aagattcatagagg

SEQ ID NO: 6965 - DNA, 14 bp, synthetic construct
  source 1..14: mol_type = other DNA
acttcacgccgcgt

SEQ ID NO: 6966 - DNA, 14 bp, synthetic construct
  source 1..14: mol_type = other DNA
gcgaggactttgca

SEQ ID NO: 6967 - DNA, 14 bp, synthetic construct
  source 1..14: mol_type = other DNA
cttgcccatgagag

SEQ ID NO: 6968 - DNA, 14 bp, synthetic construct
  source 1..14: mol_type = other DNA
agcctctgcgtcca

SEQ ID NO: 6969 - DNA, 14 bp, synthetic construct
  source 1..14: mol_type = other DNA
cttataacccggga

SEQ ID NO: 6970 - DNA, 14 bp, synthetic construct
  source 1..14: mol_type = other DNA
gactgcttggagag

SEQ ID NO: 6971 - DNA, 14 bp, synthetic construct
  source 1..14: mol_type = other DNA
ggttcccaaatacc

SEQ ID NO: 6972 - DNA, 14 bp, synthetic construct
  source 1..14: mol_type = other DNA
cctgcagtgacagt

SEQ ID NO: 6973 - DNA, 14 bp, synthetic construct
  source 1..14: mol_type = other DNA
ccaatcgcgaatta

SEQ ID NO: 6974 - DNA, 14 bp, synthetic construct
  source 1..14: mol_type = other DNA
cggccataatgtca

SEQ ID NO: 6975 - DNA, 14 bp, synthetic construct
  source 1..14: mol_type = other DNA
actaacctgggata

SEQ ID NO: 6976 - DNA, 14 bp, synthetic construct
  source 1..14: mol_type = other DNA
aatgcacttcggaa

SEQ ID NO: 6977 - DNA, 14 bp, synthetic construct
  source 1..14: mol_type = other DNA
gagtgagccatgtg

SEQ ID NO: 6978 - DNA, 14 bp, synthetic construct
  source 1..14: mol_type = other DNA
ctcaccgtatccac

SEQ ID NO: 6979 - DNA, 14 bp, synthetic construct
  source 1..14: mol_type = other DNA
aaacgctcatgtga

SEQ ID NO: 6980 - DNA, 14 bp, synthetic construct
  source 1..14: mol_type = other DNA
agctaataagcgtg

SEQ ID NO: 6981 - DNA, 14 bp, synthetic construct
  source 1..14: mol_type = other DNA
tgaaaagggtgtga

SEQ ID NO: 6982 - DNA, 14 bp, synthetic construct
  source 1..14: mol_type = other DNA
aagattaacctgag

SEQ ID NO: 6983 - DNA, 14 bp, synthetic construct
  source 1..14: mol_type = other DNA
ggcaacttcatacc

SEQ ID NO: 6984 - DNA, 14 bp, synthetic construct
  source 1..14: mol_type = other DNA
gctgcacgtacact

SEQ ID NO: 6985 - DNA, 14 bp, synthetic construct
  source 1..14: mol_type = other DNA
tcgtgggatcaccc

SEQ ID NO: 6986 - DNA, 14 bp, synthetic construct
  source 1..14: mol_type = other DNA
gaacggatcgtgtg

SEQ ID NO: 6987 - DNA, 14 bp, synthetic construct
  source 1..14: mol_type = other DNA
gacctcattgaccg

SEQ ID NO: 6988 - DNA, 14 bp, synthetic construct
  source 1..14: mol_type = other DNA
gagcgtgtgacgtg

SEQ ID NO: 6989 - DNA, 14 bp, synthetic construct
  source 1..14: mol_type = other DNA
ccagagaatatggt

SEQ ID NO: 6990 - DNA, 14 bp, synthetic construct
  source 1..14: mol_type = other DNA
gtcaagatgcagat

SEQ ID NO: 6991 - DNA, 14 bp, synthetic construct
  source 1..14: mol_type = other DNA
tctcgtgggacaag

SEQ ID NO: 6992 - DNA, 14 bp, synthetic construct
  source 1..14: mol_type = other DNA
agtttgcgacagaa

SEQ ID NO: 6993 - DNA, 14 bp, synthetic construct
  source 1..14: mol_type = other DNA
agcaagctgggctt

SEQ ID NO: 6994 - DNA, 14 bp, synthetic construct
  source 1..14: mol_type = other DNA
aattagggtaaccg

SEQ ID NO: 6995 - DNA, 14 bp, synthetic construct
  source 1..14: mol_type = other DNA
tttggacggaggcg

SEQ ID NO: 6996 - DNA, 14 bp, synthetic construct
  source 1..14: mol_type = other DNA
ccttgagacagtag

SEQ ID NO: 6997 - DNA, 14 bp, synthetic construct
  source 1..14: mol_type = other DNA
acactagttggaga

SEQ ID NO: 6998 - DNA, 14 bp, synthetic construct
  source 1..14: mol_type = other DNA
tcgcgtctaaacgg

SEQ ID NO: 6999 - DNA, 14 bp, synthetic construct
  source 1..14: mol_type = other DNA
ctcgagctataccg

SEQ ID NO: 7000 - DNA, 14 bp, synthetic construct
  source 1..14: mol_type = other DNA
ggaggataattaag

SEQ ID NO: 7001 - DNA, 14 bp, synthetic construct
  source 1..14: mol_type = other DNA
aaggttcctgccag

SEQ ID NO: 7002 - DNA, 14 bp, synthetic construct
  source 1..14: mol_type = other DNA
aaactatgcatagg

SEQ ID NO: 7003 - DNA, 14 bp, synthetic construct
  source 1..14: mol_type = other DNA
tcgcccataaaggt

SEQ ID NO: 7004 - DNA, 14 bp, synthetic construct
  source 1..14: mol_type = other DNA
agtggctggtaccg

SEQ ID NO: 7005 - DNA, 14 bp, synthetic construct
  source 1..14: mol_type = other DNA
tggcgtaagagata

SEQ ID NO: 7006 - DNA, 14 bp, synthetic construct
  source 1..14: mol_type = other DNA
cttagcacatcccg

SEQ ID NO: 7007 - DNA, 14 bp, synthetic construct
  source 1..14: mol_type = other DNA
caaatgccggttag

SEQ ID NO: 7008 - DNA, 14 bp, synthetic construct
  source 1..14: mol_type = other DNA
ccacctgactctgg

SEQ ID NO: 7009 - DNA, 14 bp, synthetic construct
  source 1..14: mol_type = other DNA
ctgcttaaccggca

SEQ ID NO: 7010 - DNA, 14 bp, synthetic construct
  source 1..14: mol_type = other DNA
tgggtggtagacgc

SEQ ID NO: 7011 - DNA, 14 bp, synthetic construct
  source 1..14: mol_type = other DNA
tccgcttagacgcc

SEQ ID NO: 7012 - DNA, 14 bp, synthetic construct
  source 1..14: mol_type = other DNA
gcgattcgcctcac

SEQ ID NO: 7013 - DNA, 14 bp, synthetic construct
  source 1..14: mol_type = other DNA
cggcctacttcacc

SEQ ID NO: 7014 - DNA, 14 bp, synthetic construct
  source 1..14: mol_type = other DNA
atcggtcactcaca

SEQ ID NO: 7015 - DNA, 14 bp, synthetic construct
  source 1..14: mol_type = other DNA
ccacacttggtaga

SEQ ID NO: 7016 - DNA, 14 bp, synthetic construct
  source 1..14: mol_type = other DNA
tccagactgacata

SEQ ID NO: 7017 - DNA, 14 bp, synthetic construct
  source 1..14: mol_type = other DNA
cggagcagttctcc

SEQ ID NO: 7018 - DNA, 14 bp, synthetic construct
  source 1..14: mol_type = other DNA
acgtacgtctcggc

SEQ ID NO: 7019 - DNA, 14 bp, synthetic construct
  source 1..14: mol_type = other DNA
gatgatgggtcgaa

SEQ ID NO: 7020 - DNA, 14 bp, synthetic construct
  source 1..14: mol_type = other DNA
cacccgtacagatt

SEQ ID NO: 7021 - DNA, 14 bp, synthetic construct
  source 1..14: mol_type = other DNA
agatagtctgcggc

SEQ ID NO: 7022 - DNA, 14 bp, synthetic construct
  source 1..14: mol_type = other DNA
ttcacccaatgagc

SEQ ID NO: 7023 - DNA, 14 bp, synthetic construct
  source 1..14: mol_type = other DNA
gcaccgaatattac

SEQ ID NO: 7024 - DNA, 14 bp, synthetic construct
  source 1..14: mol_type = other DNA
ggaaccccgttcta

SEQ ID NO: 7025 - DNA, 14 bp, synthetic construct
  source 1..14: mol_type = other DNA
cactaggacggttg

SEQ ID NO: 7026 - DNA, 14 bp, synthetic construct
  source 1..14: mol_type = other DNA
cagccccaatttga

SEQ ID NO: 7027 - DNA, 14 bp, synthetic construct
  source 1..14: mol_type = other DNA
ttaatgacccaaga

SEQ ID NO: 7028 - DNA, 14 bp, synthetic construct
  source 1..14: mol_type = other DNA
acccacattcaatg

SEQ ID NO: 7029 - DNA, 14 bp, synthetic construct
  source 1..14: mol_type = other DNA
ggcgaataggctat

SEQ ID NO: 7030 - DNA, 14 bp, synthetic construct
  source 1..14: mol_type = other DNA
caagtcccacttga

SEQ ID NO: 7031 - DNA, 14 bp, synthetic construct
  source 1..14: mol_type = other DNA
cgatcggttgcgcc

SEQ ID NO: 7032 - DNA, 14 bp, synthetic construct
  source 1..14: mol_type = other DNA
gtgtaacagtgcca

SEQ ID NO: 7033 - DNA, 14 bp, synthetic construct
  source 1..14: mol_type = other DNA
tcgcgcaacttggc

SEQ ID NO: 7034 - DNA, 14 bp, synthetic construct
  source 1..14: mol_type = other DNA
taggtcccgtccac

SEQ ID NO: 7035 - DNA, 14 bp, synthetic construct
  source 1..14: mol_type = other DNA
ttccgtggagggac

SEQ ID NO: 7036 - DNA, 14 bp, synthetic construct
  source 1..14: mol_type = other DNA
gcttgccaggagct

SEQ ID NO: 7037 - DNA, 14 bp, synthetic construct
  source 1..14: mol_type = other DNA
aatcctatcgcgcg

SEQ ID NO: 7038 - DNA, 14 bp, synthetic construct
  source 1..14: mol_type = other DNA
gggtcctaatccca

SEQ ID NO: 7039 - DNA, 14 bp, synthetic construct
  source 1..14: mol_type = other DNA
tctacagggtaaag

SEQ ID NO: 7040 - DNA, 14 bp, synthetic construct
  source 1..14: mol_type = other DNA
aatgcccagtgcta

SEQ ID NO: 7041 - DNA, 14 bp, synthetic construct
  source 1..14: mol_type = other DNA
agcccttgaccggt

SEQ ID NO: 7042 - DNA, 14 bp, synthetic construct
  source 1..14: mol_type = other DNA
agtggtcacatacc

SEQ ID NO: 7043 - DNA, 14 bp, synthetic construct
  source 1..14: mol_type = other DNA
ctgaggaaatcgta

SEQ ID NO: 7044 - DNA, 14 bp, synthetic construct
  source 1..14: mol_type = other DNA
cccgctcggtagtc

SEQ ID NO: 7045 - DNA, 14 bp, synthetic construct
  source 1..14: mol_type = other DNA
cacgcgaactctgt

SEQ ID NO: 7046 - DNA, 14 bp, synthetic construct
  source 1..14: mol_type = other DNA
ccaactgagatgta

SEQ ID NO: 7047 - DNA, 14 bp, synthetic construct
  source 1..14: mol_type = other DNA
ggcgagtgcgtagt

SEQ ID NO: 7048 - DNA, 14 bp, synthetic construct
  source 1..14: mol_type = other DNA
agagataattgacg

SEQ ID NO: 7049 - DNA, 14 bp, synthetic construct
  source 1..14: mol_type = other DNA
gccatcctagtaca

SEQ ID NO: 7050 - DNA, 14 bp, synthetic construct
  source 1..14: mol_type = other DNA
ccggctattcgccg

SEQ ID NO: 7051 - DNA, 14 bp, synthetic construct
  source 1..14: mol_type = other DNA
caggtggggtccct

SEQ ID NO: 7052 - DNA, 14 bp, synthetic construct
  source 1..14: mol_type = other DNA
tacaactaacctca

SEQ ID NO: 7053 - DNA, 14 bp, synthetic construct
  source 1..14: mol_type = other DNA
tgggagattgggcg

SEQ ID NO: 7054 - DNA, 14 bp, synthetic construct
  source 1..14: mol_type = other DNA
taccaataacgaat

SEQ ID NO: 7055 - DNA, 14 bp, synthetic construct
  source 1..14: mol_type = other DNA
gatggaaggctgct

SEQ ID NO: 7056 - DNA, 14 bp, synthetic construct
  source 1..14: mol_type = other DNA
gaacctctcgaaat

SEQ ID NO: 7057 - DNA, 14 bp, synthetic construct
  source 1..14: mol_type = other DNA
atgtgaacaacctg

SEQ ID NO: 7058 - DNA, 14 bp, synthetic construct
  source 1..14: mol_type = other DNA
cccggattcaggtg

SEQ ID NO: 7059 - DNA, 14 bp, synthetic construct
  source 1..14: mol_type = other DNA
aaaccccaggttct

SEQ ID NO: 7060 - DNA, 14 bp, synthetic construct
  source 1..14: mol_type = other DNA
cggcctgactactc

SEQ ID NO: 7061 - DNA, 14 bp, synthetic construct
  source 1..14: mol_type = other DNA
ggcttcggggtcac

SEQ ID NO: 7062 - DNA, 14 bp, synthetic construct
  source 1..14: mol_type = other DNA
aacgattccgaatc

SEQ ID NO: 7063 - DNA, 14 bp, synthetic construct
  source 1..14: mol_type = other DNA
tggtacgatagaac

SEQ ID NO: 7064 - DNA, 14 bp, synthetic construct
  source 1..14: mol_type = other DNA
gaatcctagatccg

SEQ ID NO: 7065 - DNA, 14 bp, synthetic construct
  source 1..14: mol_type = other DNA
agaaccatttaggg

SEQ ID NO: 7066 - DNA, 14 bp, synthetic construct
  source 1..14: mol_type = other DNA
gtacgataacctaa

SEQ ID NO: 7067 - DNA, 14 bp, synthetic construct
  source 1..14: mol_type = other DNA
gcgtaaatgcaatg

SEQ ID NO: 7068 - DNA, 14 bp, synthetic construct
  source 1..14: mol_type = other DNA
tagctaaatacaaa

SEQ ID NO: 7069 - DNA, 14 bp, synthetic construct
  source 1..14: mol_type = other DNA
ccgcgttacctccg

SEQ ID NO: 7070 - DNA, 14 bp, synthetic construct
  source 1..14: mol_type = other DNA
ccggtacagtgtca

SEQ ID NO: 7071 - DNA, 14 bp, synthetic construct
  source 1..14: mol_type = other DNA
ttcaaacgacaaat

SEQ ID NO: 7072 - DNA, 14 bp, synthetic construct
  source 1..14: mol_type = other DNA
tgcggttgacagga

SEQ ID NO: 7073 - DNA, 14 bp, synthetic construct
  source 1..14: mol_type = other DNA
actccctaaaaaat

SEQ ID NO: 7074 - DNA, 14 bp, synthetic construct
  source 1..14: mol_type = other DNA
ccggtgagctctcg

SEQ ID NO: 7075 - DNA, 14 bp, synthetic construct
  source 1..14: mol_type = other DNA
tcgagatccaatgc

SEQ ID NO: 7076 - DNA, 14 bp, synthetic construct
  source 1..14: mol_type = other DNA
aacgcgtgtcgggt

SEQ ID NO: 7077 - DNA, 14 bp, synthetic construct
  source 1..14: mol_type = other DNA
ccgaccttgatcgc

SEQ ID NO: 7078 - DNA, 14 bp, synthetic construct
  source 1..14: mol_type = other DNA
ggctgctatacgcc

SEQ ID NO: 7079 - DNA, 14 bp, synthetic construct
  source 1..14: mol_type = other DNA
agacctcgaatgct

SEQ ID NO: 7080 - DNA, 14 bp, synthetic construct
  source 1..14: mol_type = other DNA
atggagacaggtgt

SEQ ID NO: 7081 - DNA, 14 bp, synthetic construct
  source 1..14: mol_type = other DNA
ccttgacgtgcgaa

SEQ ID NO: 7082 - DNA, 14 bp, synthetic construct
  source 1..14: mol_type = other DNA
cgccgtcttccggg

SEQ ID NO: 7083 - DNA, 14 bp, synthetic construct
  source 1..14: mol_type = other DNA
cgatacacgtatca

SEQ ID NO: 7084 - DNA, 14 bp, synthetic construct
  source 1..14: mol_type = other DNA
caggaacttgagat

SEQ ID NO: 7085 - DNA, 14 bp, synthetic construct
  source 1..14: mol_type = other DNA
gaggttagcgtgcg

SEQ ID NO: 7086 - DNA, 14 bp, synthetic construct
  source 1..14: mol_type = other DNA
cagtacggctacct

SEQ ID NO: 7087 - DNA, 14 bp, synthetic construct
  source 1..14: mol_type = other DNA
aaccaggctctctg

SEQ ID NO: 7088 - DNA, 14 bp, synthetic construct
  source 1..14: mol_type = other DNA
aagtcaaacatagt

SEQ ID NO: 7089 - DNA, 14 bp, synthetic construct
  source 1..14: mol_type = other DNA
gcagactttcagca

SEQ ID NO: 7090 - DNA, 14 bp, synthetic construct
  source 1..14: mol_type = other DNA
gtagctcagaatga

SEQ ID NO: 7091 - DNA, 14 bp, synthetic construct
  source 1..14: mol_type = other DNA
gaataactatcgcc

SEQ ID NO: 7092 - DNA, 14 bp, synthetic construct
  source 1..14: mol_type = other DNA
tcaagtaggccgct

SEQ ID NO: 7093 - DNA, 14 bp, synthetic construct
  source 1..14: mol_type = other DNA
aggcatggtcgact

SEQ ID NO: 7094 - DNA, 14 bp, synthetic construct
  source 1..14: mol_type = other DNA
caacgtgtagcatc

SEQ ID NO: 7095 - DNA, 14 bp, synthetic construct
  source 1..14: mol_type = other DNA
cgtgggtactcacc

SEQ ID NO: 7096 - DNA, 14 bp, synthetic construct
  source 1..14: mol_type = other DNA
atcttgcagggaac

SEQ ID NO: 7097 - DNA, 14 bp, synthetic construct
  source 1..14: mol_type = other DNA
cggaatcatgctac

SEQ ID NO: 7098 - DNA, 14 bp, synthetic construct
  source 1..14: mol_type = other DNA
attcgacaatcgcc

SEQ ID NO: 7099 - DNA, 14 bp, synthetic construct
  source 1..14: mol_type = other DNA
gatttcgcagcagg

SEQ ID NO: 7100 - DNA, 14 bp, synthetic construct
  source 1..14: mol_type = other DNA
ttggcaggcggatg

SEQ ID NO: 7101 - DNA, 14 bp, synthetic construct
  source 1..14: mol_type = other DNA
atgtcccacgatcc

SEQ ID NO: 7102 - DNA, 14 bp, synthetic construct
  source 1..14: mol_type = other DNA
tcgaacgatccctc

SEQ ID NO: 7103 - DNA, 14 bp, synthetic construct
  source 1..14: mol_type = other DNA
gcggacacacttat

SEQ ID NO: 7104 - DNA, 14 bp, synthetic construct
  source 1..14: mol_type = other DNA
actattggcgcggg

SEQ ID NO: 7105 - DNA, 14 bp, synthetic construct
  source 1..14: mol_type = other DNA
ggatccacatatgg

SEQ ID NO: 7106 - DNA, 14 bp, synthetic construct
  source 1..14: mol_type = other DNA
cagttggcactaaa

SEQ ID NO: 7107 - DNA, 14 bp, synthetic construct
  source 1..14: mol_type = other DNA
tcgcctgcgctaag

SEQ ID NO: 7108 - DNA, 14 bp, synthetic construct
  source 1..14: mol_type = other DNA
tcgccgagcgttac

SEQ ID NO: 7109 - DNA, 14 bp, synthetic construct
  source 1..14: mol_type = other DNA
ttgaacaaaacatc

SEQ ID NO: 7110 - DNA, 14 bp, synthetic construct
  source 1..14: mol_type = other DNA
ccgtcggcttacga

SEQ ID NO: 7111 - DNA, 14 bp, synthetic construct
  source 1..14: mol_type = other DNA
gttcaaacataagg

SEQ ID NO: 7112 - DNA, 14 bp, synthetic construct
  source 1..14: mol_type = other DNA
actgcaacctggct

SEQ ID NO: 7113 - DNA, 14 bp, synthetic construct
  source 1..14: mol_type = other DNA
gcggtcggccttga

SEQ ID NO: 7114 - DNA, 14 bp, synthetic construct
  source 1..14: mol_type = other DNA
aaacactaggtgtc

SEQ ID NO: 7115 - DNA, 14 bp, synthetic construct
  source 1..14: mol_type = other DNA
gcggttagtcaagc

SEQ ID NO: 7116 - DNA, 14 bp, synthetic construct
  source 1..14: mol_type = other DNA
tgcgaacattaaaa

SEQ ID NO: 7117 - DNA, 14 bp, synthetic construct
  source 1..14: mol_type = other DNA
taaagaagatgtcc

SEQ ID NO: 7118 - DNA, 14 bp, synthetic construct
  source 1..14: mol_type = other DNA
ggtggcgaatgcta

SEQ ID NO: 7119 - DNA, 14 bp, synthetic construct
  source 1..14: mol_type = other DNA
cacgtctgggtccc

SEQ ID NO: 7120 - DNA, 14 bp, synthetic construct
  source 1..14: mol_type = other DNA
gacgcgcttgaata

SEQ ID NO: 7121 - DNA, 14 bp, synthetic construct
  source 1..14: mol_type = other DNA
agtcggctctccgg

SEQ ID NO: 7122 - DNA, 14 bp, synthetic construct
  source 1..14: mol_type = other DNA
gagcttactaaaga

SEQ ID NO: 7123 - DNA, 14 bp, synthetic construct
  source 1..14: mol_type = other DNA
atggctagtgcgcg

SEQ ID NO: 7124 - DNA, 14 bp, synthetic construct
  source 1..14: mol_type = other DNA
actacaggcgcatt

SEQ ID NO: 7125 - DNA, 14 bp, synthetic construct
  source 1..14: mol_type = other DNA
tacgaggtactgca

SEQ ID NO: 7126 - DNA, 14 bp, synthetic construct
  source 1..14: mol_type = other DNA
tgtgccgaatcgag

SEQ ID NO: 7127 - DNA, 14 bp, synthetic construct
  source 1..14: mol_type = other DNA
gtaccgatgggctg

SEQ ID NO: 7128 - DNA, 14 bp, synthetic construct
  source 1..14: mol_type = other DNA
gtccagtactccca

SEQ ID NO: 7129 - DNA, 14 bp, synthetic construct
  source 1..14: mol_type = other DNA
aggcgactacagtt

SEQ ID NO: 7130 - DNA, 14 bp, synthetic construct
  source 1..14: mol_type = other DNA
atcagggtgcgctc

SEQ ID NO: 7131 - DNA, 14 bp, synthetic construct
  source 1..14: mol_type = other DNA
ggaaattgaagcgt

SEQ ID NO: 7132 - DNA, 14 bp, synthetic construct
  source 1..14: mol_type = other DNA
gagataaggctaat

SEQ ID NO: 7133 - DNA, 14 bp, synthetic construct
  source 1..14: mol_type = other DNA
tttagagccgaccg

SEQ ID NO: 7134 - DNA, 14 bp, synthetic construct
  source 1..14: mol_type = other DNA
gttcgcgaccgggt

SEQ ID NO: 7135 - DNA, 14 bp, synthetic construct
  source 1..14: mol_type = other DNA
catcgtggaagagt

SEQ ID NO: 7136 - DNA, 14 bp, synthetic construct
  source 1..14: mol_type = other DNA
aagtagttgccgca

SEQ ID NO: 7137 - DNA, 14 bp, synthetic construct
  source 1..14: mol_type = other DNA
atggctgcataagc

SEQ ID NO: 7138 - DNA, 14 bp, synthetic construct
  source 1..14: mol_type = other DNA
gatggggctataca

SEQ ID NO: 7139 - DNA, 14 bp, synthetic construct
  source 1..14: mol_type = other DNA
aggatcttcggcac

SEQ ID NO: 7140 - DNA, 14 bp, synthetic construct
  source 1..14: mol_type = other DNA
ctacctccgctcag

SEQ ID NO: 7141 - DNA, 14 bp, synthetic construct
  source 1..14: mol_type = other DNA
cgatgattgacgca

SEQ ID NO: 7142 - DNA, 14 bp, synthetic construct
  source 1..14: mol_type = other DNA
aactaaactcgact

SEQ ID NO: 7143 - DNA, 14 bp, synthetic construct
  source 1..14: mol_type = other DNA
gactcgtccctcac

SEQ ID NO: 7144 - DNA, 14 bp, synthetic construct
  source 1..14: mol_type = other DNA
ggtcacagagaatt

SEQ ID NO: 7145 - DNA, 14 bp, synthetic construct
  source 1..14: mol_type = other DNA
cgggatacactgtg

SEQ ID NO: 7146 - DNA, 14 bp, synthetic construct
  source 1..14: mol_type = other DNA
tcgccaacgtatca

SEQ ID NO: 7147 - DNA, 14 bp, synthetic construct
  source 1..14: mol_type = other DNA
ttaggccgaactgc

SEQ ID NO: 7148 - DNA, 14 bp, synthetic construct
  source 1..14: mol_type = other DNA
tcacaaggtaggct

SEQ ID NO: 7149 - DNA, 14 bp, synthetic construct
  source 1..14: mol_type = other DNA
taccggcaacttaa

SEQ ID NO: 7150 - DNA, 14 bp, synthetic construct
  source 1..14: mol_type = other DNA
acagcttaatcagg

SEQ ID NO: 7151 - DNA, 14 bp, synthetic construct
  source 1..14: mol_type = other DNA
agtctaaagtaaac

SEQ ID NO: 7152 - DNA, 14 bp, synthetic construct
  source 1..14: mol_type = other DNA
ccccgtgcccttcc

SEQ ID NO: 7153 - DNA, 14 bp, synthetic construct
  source 1..14: mol_type = other DNA
ttagaaacgccata

SEQ ID NO: 7154 - DNA, 14 bp, synthetic construct
  source 1..14: mol_type = other DNA
gcacatacataaat

SEQ ID NO: 7155 - DNA, 14 bp, synthetic construct
  source 1..14: mol_type = other DNA
tatccgcgtgcagg

SEQ ID NO: 7156 - DNA, 14 bp, synthetic construct
  source 1..14: mol_type = other DNA
ccgcgtccgtactg

SEQ ID NO: 7157 - DNA, 14 bp, synthetic construct
  source 1..14: mol_type = other DNA
tgagaatcctaagg

SEQ ID NO: 7158 - DNA, 14 bp, synthetic construct
  source 1..14: mol_type = other DNA
tcgacatatccagc

SEQ ID NO: 7159 - DNA, 14 bp, synthetic construct
  source 1..14: mol_type = other DNA
gttctccggaggcc

SEQ ID NO: 7160 - DNA, 14 bp, synthetic construct
  source 1..14: mol_type = other DNA
ggacggatacggtt

SEQ ID NO: 7161 - DNA, 14 bp, synthetic construct
  source 1..14: mol_type = other DNA
agatcacacagttg

SEQ ID NO: 7162 - DNA, 14 bp, synthetic construct
  source 1..14: mol_type = other DNA
gggggtttcggagg

SEQ ID NO: 7163 - DNA, 14 bp, synthetic construct
  source 1..14: mol_type = other DNA
cacagctaattagg

SEQ ID NO: 7164 - DNA, 14 bp, synthetic construct
  source 1..14: mol_type = other DNA
cgaatgaccgtgtg

SEQ ID NO: 7165 - DNA, 14 bp, synthetic construct
  source 1..14: mol_type = other DNA
tacctgtcaggagg

SEQ ID NO: 7166 - DNA, 14 bp, synthetic construct
  source 1..14: mol_type = other DNA
tgaccgtcagacgt

SEQ ID NO: 7167 - DNA, 14 bp, synthetic construct
  source 1..14: mol_type = other DNA
gcggaattcatgaa

SEQ ID NO: 7168 - DNA, 14 bp, synthetic construct
  source 1..14: mol_type = other DNA
ctggacccctctac

SEQ ID NO: 7169 - DNA, 14 bp, synthetic construct
  source 1..14: mol_type = other DNA
atggggaccgcatt

SEQ ID NO: 7170 - DNA, 14 bp, synthetic construct
  source 1..14: mol_type = other DNA
taactcgtcgaggg

SEQ ID NO: 7171 - DNA, 14 bp, synthetic construct
  source 1..14: mol_type = other DNA
cctggggagtatgc

SEQ ID NO: 7172 - DNA, 14 bp, synthetic construct
  source 1..14: mol_type = other DNA
aggtcctcgcctcg

SEQ ID NO: 7173 - DNA, 14 bp, synthetic construct
  source 1..14: mol_type = other DNA
gttacgcgacagta

SEQ ID NO: 7174 - DNA, 14 bp, synthetic construct
  source 1..14: mol_type = other DNA
taggcaggtctcac

SEQ ID NO: 7175 - DNA, 14 bp, synthetic construct
  source 1..14: mol_type = other DNA
ttcaagacgtcgcc

SEQ ID NO: 7176 - DNA, 14 bp, synthetic construct
  source 1..14: mol_type = other DNA
ggaatcgaagtgta

SEQ ID NO: 7177 - DNA, 14 bp, synthetic construct
  source 1..14: mol_type = other DNA
acagcgtcgcctat

SEQ ID NO: 7178 - DNA, 14 bp, synthetic construct
  source 1..14: mol_type = other DNA
gctaggaatactcg

SEQ ID NO: 7179 - DNA, 14 bp, synthetic construct
  source 1..14: mol_type = other DNA
ggcataggggcctt

SEQ ID NO: 7180 - DNA, 14 bp, synthetic construct
  source 1..14: mol_type = other DNA
agctttaacgagcg

SEQ ID NO: 7181 - DNA, 14 bp, synthetic construct
  source 1..14: mol_type = other DNA
cggtcgcatacact

SEQ ID NO: 7182 - DNA, 14 bp, synthetic construct
  source 1..14: mol_type = other DNA
agtgcttggaagac

SEQ ID NO: 7183 - DNA, 14 bp, synthetic construct
  source 1..14: mol_type = other DNA
gtaatgatagaggg

SEQ ID NO: 7184 - DNA, 14 bp, synthetic construct
  source 1..14: mol_type = other DNA
gtcacgcctatgac

SEQ ID NO: 7185 - DNA, 14 bp, synthetic construct
  source 1..14: mol_type = other DNA
gaagcctgttcggg

SEQ ID NO: 7186 - DNA, 14 bp, synthetic construct
  source 1..14: mol_type = other DNA
ctgcgctcgtggcg

SEQ ID NO: 7187 - DNA, 14 bp, synthetic construct
  source 1..14: mol_type = other DNA
agatgtcctgcgcg

SEQ ID NO: 7188 - DNA, 14 bp, synthetic construct
  source 1..14: mol_type = other DNA
aaaccaaccttact

SEQ ID NO: 7189 - DNA, 14 bp, synthetic construct
  source 1..14: mol_type = other DNA
agcgatgtatccga

SEQ ID NO: 7190 - DNA, 14 bp, synthetic construct
  source 1..14: mol_type = other DNA
agagctcccgtctc

SEQ ID NO: 7191 - DNA, 14 bp, synthetic construct
  source 1..14: mol_type = other DNA
aattgcctaccccc

SEQ ID NO: 7192 - DNA, 14 bp, synthetic construct
  source 1..14: mol_type = other DNA
aatgcaaggtctca

SEQ ID NO: 7193 - DNA, 14 bp, synthetic construct
  source 1..14: mol_type = other DNA
taatcaggctaccg

SEQ ID NO: 7194 - DNA, 14 bp, synthetic construct
  source 1..14: mol_type = other DNA
ggagaaagtttcgc

SEQ ID NO: 7195 - DNA, 14 bp, synthetic construct
  source 1..14: mol_type = other DNA
cagggttgatgcaa

SEQ ID NO: 7196 - DNA, 14 bp, synthetic construct
  source 1..14: mol_type = other DNA
tataagcaaacaat

SEQ ID NO: 7197 - DNA, 14 bp, synthetic construct
  source 1..14: mol_type = other DNA
ggcaggttacagta

SEQ ID NO: 7198 - DNA, 14 bp, synthetic construct
  source 1..14: mol_type = other DNA
gggaggtgacctct

SEQ ID NO: 7199 - DNA, 14 bp, synthetic construct
  source 1..14: mol_type = other DNA
cggtgaacttaccg

SEQ ID NO: 7200 - DNA, 14 bp, synthetic construct
  source 1..14: mol_type = other DNA
atcgatctcagacg

SEQ ID NO: 7201 - DNA, 14 bp, synthetic construct
  source 1..14: mol_type = other DNA
caccctgccctagt

SEQ ID NO: 7202 - DNA, 14 bp, synthetic construct
  source 1..14: mol_type = other DNA
aacgtctaccggta

SEQ ID NO: 7203 - DNA, 14 bp, synthetic construct
  source 1..14: mol_type = other DNA
cgttaagccaagtc

SEQ ID NO: 7204 - DNA, 14 bp, synthetic construct
  source 1..14: mol_type = other DNA
cgatgcatctcagg

SEQ ID NO: 7205 - DNA, 14 bp, synthetic construct
  source 1..14: mol_type = other DNA
gtagcggagctcct

SEQ ID NO: 7206 - DNA, 14 bp, synthetic construct
  source 1..14: mol_type = other DNA
tccaaccgaagtat

SEQ ID NO: 7207 - DNA, 14 bp, synthetic construct
  source 1..14: mol_type = other DNA
gacgttatggcggc

SEQ ID NO: 7208 - DNA, 14 bp, synthetic construct
  source 1..14: mol_type = other DNA
gcggtctagcggct

SEQ ID NO: 7209 - DNA, 14 bp, synthetic construct
  source 1..14: mol_type = other DNA
cggcagtgtcgtca

SEQ ID NO: 7210 - DNA, 14 bp, synthetic construct
  source 1..14: mol_type = other DNA
taataaccggagtg

SEQ ID NO: 7211 - DNA, 14 bp, synthetic construct
  source 1..14: mol_type = other DNA
tgtccgggtccaac

SEQ ID NO: 7212 - DNA, 14 bp, synthetic construct
  source 1..14: mol_type = other DNA
ctcaaatcgcctgg

SEQ ID NO: 7213 - DNA, 14 bp, synthetic construct
  source 1..14: mol_type = other DNA
tacgactaacaatc

SEQ ID NO: 7214 - DNA, 14 bp, synthetic construct
  source 1..14: mol_type = other DNA
gtagctgggaggtg

SEQ ID NO: 7215 - DNA, 14 bp, synthetic construct
  source 1..14: mol_type = other DNA
cccgttgtcaaacc

SEQ ID NO: 7216 - DNA, 14 bp, synthetic construct
  source 1..14: mol_type = other DNA
ccggacgatcttcg

SEQ ID NO: 7217 - DNA, 14 bp, synthetic construct
  source 1..14: mol_type = other DNA
gagctacttgcgag

SEQ ID NO: 7218 - DNA, 14 bp, synthetic construct
  source 1..14: mol_type = other DNA
gtatcgaatcccac

SEQ ID NO: 7219 - DNA, 14 bp, synthetic construct
  source 1..14: mol_type = other DNA
tcgtggacgcgtgc

SEQ ID NO: 7220 - DNA, 14 bp, synthetic construct
  source 1..14: mol_type = other DNA
taaacctacacatc

SEQ ID NO: 7221 - DNA, 14 bp, synthetic construct
  source 1..14: mol_type = other DNA
cgatgatgaagggt

SEQ ID NO: 7222 - DNA, 14 bp, synthetic construct
  source 1..14: mol_type = other DNA
ataatgctaggaaa

SEQ ID NO: 7223 - DNA, 14 bp, synthetic construct
  source 1..14: mol_type = other DNA
taggatccgtacgg

SEQ ID NO: 7224 - DNA, 14 bp, synthetic construct
  source 1..14: mol_type = other DNA
tgccgctgacctgg

SEQ ID NO: 7225 - DNA, 14 bp, synthetic construct
  source 1..14: mol_type = other DNA
tacccgtggcgtgc

SEQ ID NO: 7226 - DNA, 14 bp, synthetic construct
  source 1..14: mol_type = other DNA
cacagttacccgct

SEQ ID NO: 7227 - DNA, 14 bp, synthetic construct
  source 1..14: mol_type = other DNA
tgtctagagagcag

SEQ ID NO: 7228 - DNA, 14 bp, synthetic construct
  source 1..14: mol_type = other DNA
agattcacagtcgg

SEQ ID NO: 7229 - DNA, 14 bp, synthetic construct
  source 1..14: mol_type = other DNA
gatgaactccaatg

SEQ ID NO: 7230 - DNA, 14 bp, synthetic construct
  source 1..14: mol_type = other DNA
gcggataagtgctg

SEQ ID NO: 7231 - DNA, 14 bp, synthetic construct
  source 1..14: mol_type = other DNA
gcctggatggccgt

SEQ ID NO: 7232 - DNA, 14 bp, synthetic construct
  source 1..14: mol_type = other DNA
taacaaagtatcaa

SEQ ID NO: 7233 - DNA, 14 bp, synthetic construct
  source 1..14: mol_type = other DNA
atacttagcccggg

SEQ ID NO: 7234 - DNA, 14 bp, synthetic construct
  source 1..14: mol_type = other DNA
agtatgaagcgctc

SEQ ID NO: 7235 - DNA, 14 bp, synthetic construct
  source 1..14: mol_type = other DNA
cactcaggatacat

SEQ ID NO: 7236 - DNA, 14 bp, synthetic construct
  source 1..14: mol_type = other DNA
cggtcataactcag

SEQ ID NO: 7237 - DNA, 14 bp, synthetic construct
  source 1..14: mol_type = other DNA
tacagtaacgggta

SEQ ID NO: 7238 - DNA, 14 bp, synthetic construct
  source 1..14: mol_type = other DNA
taggggtcgatagc

SEQ ID NO: 7239 - DNA, 14 bp, synthetic construct
  source 1..14: mol_type = other DNA
tccagagcggtatc

SEQ ID NO: 7240 - DNA, 14 bp, synthetic construct
  source 1..14: mol_type = other DNA
gaacaaacatattc

SEQ ID NO: 7241 - DNA, 14 bp, synthetic construct
  source 1..14: mol_type = other DNA
gccctagcgtgcct

SEQ ID NO: 7242 - DNA, 14 bp, synthetic construct
  source 1..14: mol_type = other DNA
cttaccacatgaga

SEQ ID NO: 7243 - DNA, 14 bp, synthetic construct
  source 1..14: mol_type = other DNA
aaccgcttagtcag

SEQ ID NO: 7244 - DNA, 14 bp, synthetic construct
  source 1..14: mol_type = other DNA
aacgtccgtgcatc

SEQ ID NO: 7245 - DNA, 14 bp, synthetic construct
  source 1..14: mol_type = other DNA
ttgaaacaccgtaa

SEQ ID NO: 7246 - DNA, 14 bp, synthetic construct
  source 1..14: mol_type = other DNA
tgagataataggaa

SEQ ID NO: 7247 - DNA, 14 bp, synthetic construct
  source 1..14: mol_type = other DNA
cttagacaaaggtc

SEQ ID NO: 7248 - DNA, 14 bp, synthetic construct
  source 1..14: mol_type = other DNA
cccgtcagattagg

SEQ ID NO: 7249 - DNA, 14 bp, synthetic construct
  source 1..14: mol_type = other DNA
cgagggtacgtaat

SEQ ID NO: 7250 - DNA, 14 bp, synthetic construct
  source 1..14: mol_type = other DNA
cacgtctggcggat

SEQ ID NO: 7251 - DNA, 14 bp, synthetic construct
  source 1..14: mol_type = other DNA
cgtggtgagtgaag

SEQ ID NO: 7252 - DNA, 14 bp, synthetic construct
  source 1..14: mol_type = other DNA
attgagaatggaac

SEQ ID NO: 7253 - DNA, 14 bp, synthetic construct
  source 1..14: mol_type = other DNA
ttacgaagtcacag

SEQ ID NO: 7254 - DNA, 14 bp, synthetic construct
  source 1..14: mol_type = other DNA
tctgacgtaccgcc

SEQ ID NO: 7255 - DNA, 14 bp, synthetic construct
  source 1..14: mol_type = other DNA
agggacttgatccc

SEQ ID NO: 7256 - DNA, 14 bp, synthetic construct
  source 1..14: mol_type = other DNA
agtagtccggtagc

SEQ ID NO: 7257 - DNA, 14 bp, synthetic construct
  source 1..14: mol_type = other DNA
gcttgcccgaaata

SEQ ID NO: 7258 - DNA, 14 bp, synthetic construct
  source 1..14: mol_type = other DNA
tagattcagcaccg

SEQ ID NO: 7259 - DNA, 14 bp, synthetic construct
  source 1..14: mol_type = other DNA
ctgtcatgcggcgg

SEQ ID NO: 7260 - DNA, 14 bp, synthetic construct
  source 1..14: mol_type = other DNA
agactagtgataaa

SEQ ID NO: 7261 - DNA, 14 bp, synthetic construct
  source 1..14: mol_type = other DNA
cagtctaaatcgcg

SEQ ID NO: 7262 - DNA, 14 bp, synthetic construct
  source 1..14: mol_type = other DNA
tgaggttggacgag

SEQ ID NO: 7263 - DNA, 14 bp, synthetic construct
  source 1..14: mol_type = other DNA
tcattcacggggac

SEQ ID NO: 7264 - DNA, 14 bp, synthetic construct
  source 1..14: mol_type = other DNA
caggtaagccattg

SEQ ID NO: 7265 - DNA, 14 bp, synthetic construct
  source 1..14: mol_type = other DNA
cggtgctagtgagc

SEQ ID NO: 7266 - DNA, 14 bp, synthetic construct
  source 1..14: mol_type = other DNA
atgcacacgatata

SEQ ID NO: 7267 - DNA, 14 bp, synthetic construct
  source 1..14: mol_type = other DNA
gattgcgtaccgag

SEQ ID NO: 7268 - DNA, 14 bp, synthetic construct
  source 1..14: mol_type = other DNA
tcatctgaaccggt

SEQ ID NO: 7269 - DNA, 14 bp, synthetic construct
  source 1..14: mol_type = other DNA
cgctactgctgtaa

SEQ ID NO: 7270 - DNA, 14 bp, synthetic construct
  source 1..14: mol_type = other DNA
taagtgacagttgg

SEQ ID NO: 7271 - DNA, 14 bp, synthetic construct
  source 1..14: mol_type = other DNA
cagaggtgaattta

SEQ ID NO: 7272 - DNA, 14 bp, synthetic construct
  source 1..14: mol_type = other DNA
gcccctcattcgta

SEQ ID NO: 7273 - DNA, 14 bp, synthetic construct
  source 1..14: mol_type = other DNA
ccctgctgatactg

SEQ ID NO: 7274 - DNA, 14 bp, synthetic construct
  source 1..14: mol_type = other DNA
agttgtcggtggaa

SEQ ID NO: 7275 - DNA, 14 bp, synthetic construct
  source 1..14: mol_type = other DNA
ggagagttgtgtgg

SEQ ID NO: 7276 - DNA, 14 bp, synthetic construct
  source 1..14: mol_type = other DNA
tgccagccctgtct

SEQ ID NO: 7277 - DNA, 14 bp, synthetic construct
  source 1..14: mol_type = other DNA
gatcattagactga

SEQ ID NO: 7278 - DNA, 14 bp, synthetic construct
  source 1..14: mol_type = other DNA
gttgatacaacgtc

SEQ ID NO: 7279 - DNA, 14 bp, synthetic construct
  source 1..14: mol_type = other DNA
agacgcggtcttta

SEQ ID NO: 7280 - DNA, 14 bp, synthetic construct
  source 1..14: mol_type = other DNA
agctttagaatacc

SEQ ID NO: 7281 - DNA, 14 bp, synthetic construct
  source 1..14: mol_type = other DNA
ttctgcccatagca

SEQ ID NO: 7282 - DNA, 14 bp, synthetic construct
  source 1..14: mol_type = other DNA
acctgcctccgatt

SEQ ID NO: 7283 - DNA, 14 bp, synthetic construct
  source 1..14: mol_type = other DNA
ctcgtcgcgaagtt

SEQ ID NO: 7284 - DNA, 14 bp, synthetic construct
  source 1..14: mol_type = other DNA
agaagcttacttaa

SEQ ID NO: 7285 - DNA, 14 bp, synthetic construct
  source 1..14: mol_type = other DNA
ttgctcgccaaagt

SEQ ID NO: 7286 - DNA, 14 bp, synthetic construct
  source 1..14: mol_type = other DNA
gttcttacccgcaa

SEQ ID NO: 7287 - DNA, 14 bp, synthetic construct
  source 1..14: mol_type = other DNA
tcttcataccagcc

SEQ ID NO: 7288 - DNA, 14 bp, synthetic construct
  source 1..14: mol_type = other DNA
gagcgaattctagt

SEQ ID NO: 7289 - DNA, 14 bp, synthetic construct
  source 1..14: mol_type = other DNA
aaggcgaatttgtc

SEQ ID NO: 7290 - DNA, 14 bp, synthetic construct
  source 1..14: mol_type = other DNA
gaagtccgttaata

SEQ ID NO: 7291 - DNA, 14 bp, synthetic construct
  source 1..14: mol_type = other DNA
atttgaccatgaaa

SEQ ID NO: 7292 - DNA, 14 bp, synthetic construct
  source 1..14: mol_type = other DNA
tatacagtagtgca

SEQ ID NO: 7293 - DNA, 14 bp, synthetic construct
  source 1..14: mol_type = other DNA
aatcatcactgctc

SEQ ID NO: 7294 - DNA, 14 bp, synthetic construct
  source 1..14: mol_type = other DNA
gagacgggattttg

SEQ ID NO: 7295 - DNA, 14 bp, synthetic construct
  source 1..14: mol_type = other DNA
gatagcttcggata

SEQ ID NO: 7296 - DNA, 14 bp, synthetic construct
  source 1..14: mol_type = other DNA
tacggacgttgtaa

SEQ ID NO: 7297 - DNA, 14 bp, synthetic construct
  source 1..14: mol_type = other DNA
tccagtccagggtt

SEQ ID NO: 7298 - DNA, 14 bp, synthetic construct
  source 1..14: mol_type = other DNA
aataagactggttg

SEQ ID NO: 7299 - DNA, 14 bp, synthetic construct
  source 1..14: mol_type = other DNA
agtgactcgcattc

SEQ ID NO: 7300 - DNA, 14 bp, synthetic construct
  source 1..14: mol_type = other DNA
ctcccgcttcgcct

SEQ ID NO: 7301 - DNA, 14 bp, synthetic construct
  source 1..14: mol_type = other DNA
ttggctgagcaaat

SEQ ID NO: 7302 - DNA, 14 bp, synthetic construct
  source 1..14: mol_type = other DNA
tccccaccttgata

SEQ ID NO: 7303 - DNA, 14 bp, synthetic construct
  source 1..14: mol_type = other DNA
aaggagtgttctcg

SEQ ID NO: 7304 - DNA, 14 bp, synthetic construct
  source 1..14: mol_type = other DNA
acggtggcgtttaa

SEQ ID NO: 7305 - DNA, 14 bp, synthetic construct
  source 1..14: mol_type = other DNA
cttcacatcggatg

SEQ ID NO: 7306 - DNA, 14 bp, synthetic construct
  source 1..14: mol_type = other DNA
cttttcgcgggcac

SEQ ID NO: 7307 - DNA, 14 bp, synthetic construct
  source 1..14: mol_type = other DNA
ttcggggtatccgg

SEQ ID NO: 7308 - DNA, 14 bp, synthetic construct
  source 1..14: mol_type = other DNA
ctgcctgggttcaa

SEQ ID NO: 7309 - DNA, 14 bp, synthetic construct
  source 1..14: mol_type = other DNA
ttgcctaaagctca

SEQ ID NO: 7310 - DNA, 14 bp, synthetic construct
  source 1..14: mol_type = other DNA
acctagcattagat

SEQ ID NO: 7311 - DNA, 14 bp, synthetic construct
  source 1..14: mol_type = other DNA
ccttggaaattgac

SEQ ID NO: 7312 - DNA, 14 bp, synthetic construct
  source 1..14: mol_type = other DNA
gactcctgtgcgtc

SEQ ID NO: 7313 - DNA, 14 bp, synthetic construct
  source 1..14: mol_type = other DNA
taatcaaacccatt

SEQ ID NO: 7314 - DNA, 14 bp, synthetic construct
  source 1..14: mol_type = other DNA
aaatggtcctataa

SEQ ID NO: 7315 - DNA, 14 bp, synthetic construct
  source 1..14: mol_type = other DNA
attctgggcctcac

SEQ ID NO: 7316 - DNA, 14 bp, synthetic construct
  source 1..14: mol_type = other DNA
aatttccgaaaact

SEQ ID NO: 7317 - DNA, 14 bp, synthetic construct
  source 1..14: mol_type = other DNA
acgctataggagtt

SEQ ID NO: 7318 - DNA, 14 bp, synthetic construct
  source 1..14: mol_type = other DNA
taggaggaatttac

SEQ ID NO: 7319 - DNA, 14 bp, synthetic construct
  source 1..14: mol_type = other DNA
ctgcaagcatatct

SEQ ID NO: 7320 - DNA, 14 bp, synthetic construct
  source 1..14: mol_type = other DNA
tgggtcactgcctc

SEQ ID NO: 7321 - DNA, 14 bp, synthetic construct
  source 1..14: mol_type = other DNA
ggacgacttcgttg

SEQ ID NO: 7322 - DNA, 14 bp, synthetic construct
  source 1..14: mol_type = other DNA
gacactactctggt

SEQ ID NO: 7323 - DNA, 14 bp, synthetic construct
  source 1..14: mol_type = other DNA
ccatgtcgacttac

SEQ ID NO: 7324 - DNA, 14 bp, synthetic construct
  source 1..14: mol_type = other DNA
ccaggcctttgact

SEQ ID NO: 7325 - DNA, 14 bp, synthetic construct
  source 1..14: mol_type = other DNA
atgcgctcgcgtgt

SEQ ID NO: 7326 - DNA, 14 bp, synthetic construct
  source 1..14: mol_type = other DNA
gataactagtagtc

SEQ ID NO: 7327 - DNA, 14 bp, synthetic construct
  source 1..14: mol_type = other DNA
ggatatctgggtgc

SEQ ID NO: 7328 - DNA, 14 bp, synthetic construct
  source 1..14: mol_type = other DNA
gctccgctatagat

SEQ ID NO: 7329 - DNA, 14 bp, synthetic construct
  source 1..14: mol_type = other DNA
cctctccataacgt

SEQ ID NO: 7330 - DNA, 14 bp, synthetic construct
  source 1..14: mol_type = other DNA
acccgtcaagtctt

SEQ ID NO: 7331 - DNA, 14 bp, synthetic construct
  source 1..14: mol_type = other DNA
actggtccgtgagt

SEQ ID NO: 7332 - DNA, 14 bp, synthetic construct
  source 1..14: mol_type = other DNA
gtgcatgggtaact

SEQ ID NO: 7333 - DNA, 14 bp, synthetic construct
  source 1..14: mol_type = other DNA
tcttgaactaacgg

SEQ ID NO: 7334 - DNA, 14 bp, synthetic construct
  source 1..14: mol_type = other DNA
ctgcgctcttaaac

SEQ ID NO: 7335 - DNA, 14 bp, synthetic construct
  source 1..14: mol_type = other DNA
tctcccaagatgtc

SEQ ID NO: 7336 - DNA, 14 bp, synthetic construct
  source 1..14: mol_type = other DNA
attactaaccacat

SEQ ID NO: 7337 - DNA, 14 bp, synthetic construct
  source 1..14: mol_type = other DNA
tttacaagcgatga

SEQ ID NO: 7338 - DNA, 14 bp, synthetic construct
  source 1..14: mol_type = other DNA
tagtgttgcccgca

SEQ ID NO: 7339 - DNA, 14 bp, synthetic construct
  source 1..14: mol_type = other DNA
tgaatggagcgtct

SEQ ID NO: 7340 - DNA, 14 bp, synthetic construct
  source 1..14: mol_type = other DNA
atgatgttacccca

SEQ ID NO: 7341 - DNA, 14 bp, synthetic construct
  source 1..14: mol_type = other DNA
tagaatttaaggaa

SEQ ID NO: 7342 - DNA, 14 bp, synthetic construct
  source 1..14: mol_type = other DNA
tacgccatagtctg

SEQ ID NO: 7343 - DNA, 14 bp, synthetic construct
  source 1..14: mol_type = other DNA
gcgttacccatata

SEQ ID NO: 7344 - DNA, 14 bp, synthetic construct
  source 1..14: mol_type = other DNA
tagtccgccatcgt

SEQ ID NO: 7345 - DNA, 14 bp, synthetic construct
  source 1..14: mol_type = other DNA
gtacacactttcgg

SEQ ID NO: 7346 - DNA, 14 bp, synthetic construct
  source 1..14: mol_type = other DNA
tgggctttggaggg

SEQ ID NO: 7347 - DNA, 14 bp, synthetic construct
  source 1..14: mol_type = other DNA
tatggcgttcaaag

SEQ ID NO: 7348 - DNA, 14 bp, synthetic construct
  source 1..14: mol_type = other DNA
acgtcgctgactct

SEQ ID NO: 7349 - DNA, 14 bp, synthetic construct
  source 1..14: mol_type = other DNA
ctacgtcctatgaa

SEQ ID NO: 7350 - DNA, 14 bp, synthetic construct
  source 1..14: mol_type = other DNA
gtttctaggcaaac

SEQ ID NO: 7351 - DNA, 14 bp, synthetic construct
  source 1..14: mol_type = other DNA
ttacattgccgaac

SEQ ID NO: 7352 - DNA, 14 bp, synthetic construct
  source 1..14: mol_type = other DNA
gatcttacaccact

SEQ ID NO: 7353 - DNA, 14 bp, synthetic construct
  source 1..14: mol_type = other DNA
ggataactcctact

SEQ ID NO: 7354 - DNA, 14 bp, synthetic construct
  source 1..14: mol_type = other DNA
aaatattggacgtc

SEQ ID NO: 7355 - DNA, 14 bp, synthetic construct
  source 1..14: mol_type = other DNA
cacgagattagtta

SEQ ID NO: 7356 - DNA, 14 bp, synthetic construct
  source 1..14: mol_type = other DNA
gtctggcgatactc

SEQ ID NO: 7357 - DNA, 14 bp, synthetic construct
  source 1..14: mol_type = other DNA
aagccagctgtttc

SEQ ID NO: 7358 - DNA, 14 bp, synthetic construct
  source 1..14: mol_type = other DNA
ctccaaacttgtgc

SEQ ID NO: 7359 - DNA, 14 bp, synthetic construct
  source 1..14: mol_type = other DNA
caacgcctcttcgt

SEQ ID NO: 7360 - DNA, 14 bp, synthetic construct
  source 1..14: mol_type = other DNA
tcggatctaggcat

SEQ ID NO: 7361 - DNA, 14 bp, synthetic construct
  source 1..14: mol_type = other DNA
gatggagtagtggt

SEQ ID NO: 7362 - DNA, 14 bp, synthetic construct
  source 1..14: mol_type = other DNA
tccgtatggctcga

SEQ ID NO: 7363 - DNA, 14 bp, synthetic construct
  source 1..14: mol_type = other DNA
tacttgctaaaaga

SEQ ID NO: 7364 - DNA, 14 bp, synthetic construct
  source 1..14: mol_type = other DNA
gaccgggtttgtgc

SEQ ID NO: 7365 - DNA, 14 bp, synthetic construct
  source 1..14: mol_type = other DNA
agcactttgcgtag

SEQ ID NO: 7366 - DNA, 14 bp, synthetic construct
  source 1..14: mol_type = other DNA
aacttaatcagtag

SEQ ID NO: 7367 - DNA, 14 bp, synthetic construct
  source 1..14: mol_type = other DNA
ctgttaactccacg

SEQ ID NO: 7368 - DNA, 14 bp, synthetic construct
  source 1..14: mol_type = other DNA
ttaaggatatcaca

SEQ ID NO: 7369 - DNA, 14 bp, synthetic construct
  source 1..14: mol_type = other DNA
attgtgcgccccgt

SEQ ID NO: 7370 - DNA, 14 bp, synthetic construct
  source 1..14: mol_type = other DNA
caggcatgtttgcg

SEQ ID NO: 7371 - DNA, 14 bp, synthetic construct
  source 1..14: mol_type = other DNA
caattcactaagat

SEQ ID NO: 7372 - DNA, 14 bp, synthetic construct
  source 1..14: mol_type = other DNA
atttgcgaacgact

SEQ ID NO: 7373 - DNA, 14 bp, synthetic construct
  source 1..14: mol_type = other DNA
aacttcatggataa

SEQ ID NO: 7374 - DNA, 14 bp, synthetic construct
  source 1..14: mol_type = other DNA
ttaaggcacgatct

SEQ ID NO: 7375 - DNA, 14 bp, synthetic construct
  source 1..14: mol_type = other DNA
gtagttacatgaga

SEQ ID NO: 7376 - DNA, 14 bp, synthetic construct
  source 1..14: mol_type = other DNA
gcttcctctacgaa

SEQ ID NO: 7377 - DNA, 14 bp, synthetic construct
  source 1..14: mol_type = other DNA
taagacggccttat

SEQ ID NO: 7378 - DNA, 14 bp, synthetic construct
  source 1..14: mol_type = other DNA
tgagagggttctgc

SEQ ID NO: 7379 - DNA, 14 bp, synthetic construct
  source 1..14: mol_type = other DNA
cttaacgaatagta

SEQ ID NO: 7380 - DNA, 14 bp, synthetic construct
  source 1..14: mol_type = other DNA
catggttgtcgaac

SEQ ID NO: 7381 - DNA, 14 bp, synthetic construct
  source 1..14: mol_type = other DNA
tatcggagaaagtt

SEQ ID NO: 7382 - DNA, 14 bp, synthetic construct
  source 1..14: mol_type = other DNA
tacttacagctgag

SEQ ID NO: 7383 - DNA, 14 bp, synthetic construct
  source 1..14: mol_type = other DNA
cgctttaccctacg

SEQ ID NO: 7384 - DNA, 14 bp, synthetic construct
  source 1..14: mol_type = other DNA
cactgaggtatatc

SEQ ID NO: 7385 - DNA, 14 bp, synthetic construct
  source 1..14: mol_type = other DNA
aaatgctattgaac

SEQ ID NO: 7386 - DNA, 14 bp, synthetic construct
  source 1..14: mol_type = other DNA
atagccgtttgacg

SEQ ID NO: 7387 - DNA, 14 bp, synthetic construct
  source 1..14: mol_type = other DNA
ctttcggaatacgg

SEQ ID NO: 7388 - DNA, 14 bp, synthetic construct
  source 1..14: mol_type = other DNA
aggcttatggaaat

SEQ ID NO: 7389 - DNA, 14 bp, synthetic construct
  source 1..14: mol_type = other DNA
ttgaggccgtaaat

SEQ ID NO: 7390 - DNA, 14 bp, synthetic construct
  source 1..14: mol_type = other DNA
ggtgaaggattcct

SEQ ID NO: 7391 - DNA, 14 bp, synthetic construct
  source 1..14: mol_type = other DNA
gagatctggttcag

SEQ ID NO: 7392 - DNA, 14 bp, synthetic construct
  source 1..14: mol_type = other DNA
ttggttacgaacaa

SEQ ID NO: 7393 - DNA, 14 bp, synthetic construct
  source 1..14: mol_type = other DNA
tgtaaggagatgct

SEQ ID NO: 7394 - DNA, 14 bp, synthetic construct
  source 1..14: mol_type = other DNA
cgtcgttaacccat

SEQ ID NO: 7395 - DNA, 14 bp, synthetic construct
  source 1..14: mol_type = other DNA
ttggtaaaactgga

SEQ ID NO: 7396 - DNA, 14 bp, synthetic construct
  source 1..14: mol_type = other DNA
ctgtcaacttggga

SEQ ID NO: 7397 - DNA, 14 bp, synthetic construct
  source 1..14: mol_type = other DNA
tgaatcctccatcc

SEQ ID NO: 7398 - DNA, 14 bp, synthetic construct
  source 1..14: mol_type = other DNA
cggtgtgccgtgtc

SEQ ID NO: 7399 - DNA, 14 bp, synthetic construct
  source 1..14: mol_type = other DNA
ggaacgggtattgt

SEQ ID NO: 7400 - DNA, 14 bp, synthetic construct
  source 1..14: mol_type = other DNA
ttcgccctctacgg

SEQ ID NO: 7401 - DNA, 14 bp, synthetic construct
  source 1..14: mol_type = other DNA
actaggtggcttca

SEQ ID NO: 7402 - DNA, 14 bp, synthetic construct
  source 1..14: mol_type = other DNA
tctcagggcttcgg

SEQ ID NO: 7403 - DNA, 14 bp, synthetic construct
  source 1..14: mol_type = other DNA
ctggtgccggtgtg

SEQ ID NO: 7404 - DNA, 14 bp, synthetic construct
  source 1..14: mol_type = other DNA
acaaatagtgattc

SEQ ID NO: 7405 - DNA, 14 bp, synthetic construct
  source 1..14: mol_type = other DNA
atcatcgtccatga

SEQ ID NO: 7406 - DNA, 14 bp, synthetic construct
  source 1..14: mol_type = other DNA
aaacagattttccc

SEQ ID NO: 7407 - DNA, 14 bp, synthetic construct
  source 1..14: mol_type = other DNA
tccaggggttctac

SEQ ID NO: 7408 - DNA, 14 bp, synthetic construct
  source 1..14: mol_type = other DNA
ctaaaagtcagttg

SEQ ID NO: 7409 - DNA, 14 bp, synthetic construct
  source 1..14: mol_type = other DNA
ttctcgagccaggt

SEQ ID NO: 7410 - DNA, 14 bp, synthetic construct
  source 1..14: mol_type = other DNA
tggtgtggtggggc

SEQ ID NO: 7411 - DNA, 14 bp, synthetic construct
  source 1..14: mol_type = other DNA
ggctattaatgggc

SEQ ID NO: 7412 - DNA, 14 bp, synthetic construct
  source 1..14: mol_type = other DNA
agtgctagacttca

SEQ ID NO: 7413 - DNA, 14 bp, synthetic construct
  source 1..14: mol_type = other DNA
ccaggttgatcatc

SEQ ID NO: 7414 - DNA, 14 bp, synthetic construct
  source 1..14: mol_type = other DNA
ttcatccggaaata

SEQ ID NO: 7415 - DNA, 14 bp, synthetic construct
  source 1..14: mol_type = other DNA
cctctatgctgcgc

SEQ ID NO: 7416 - DNA, 14 bp, synthetic construct
  source 1..14: mol_type = other DNA
taacatctgcggtg

SEQ ID NO: 7417 - DNA, 14 bp, synthetic construct
  source 1..14: mol_type = other DNA
ttactgtaggcgcc

SEQ ID NO: 7418 - DNA, 14 bp, synthetic construct
  source 1..14: mol_type = other DNA
atatcgagttcacc

SEQ ID NO: 7419 - DNA, 14 bp, synthetic construct
  source 1..14: mol_type = other DNA
tctcttaaacgcac

SEQ ID NO: 7420 - DNA, 14 bp, synthetic construct
  source 1..14: mol_type = other DNA
ggcttttggagagc

SEQ ID NO: 7421 - DNA, 14 bp, synthetic construct
  source 1..14: mol_type = other DNA
gtaagaatgcatct

SEQ ID NO: 7422 - DNA, 14 bp, synthetic construct
  source 1..14: mol_type = other DNA
tgatgtacaaaatc

SEQ ID NO: 7423 - DNA, 14 bp, synthetic construct
  source 1..14: mol_type = other DNA
cgggaagtattgat

SEQ ID NO: 7424 - DNA, 14 bp, synthetic construct
  source 1..14: mol_type = other DNA
ttctcggggggctg

SEQ ID NO: 7425 - DNA, 14 bp, synthetic construct
  source 1..14: mol_type = other DNA
tcaggattagatca

SEQ ID NO: 7426 - DNA, 14 bp, synthetic construct
  source 1..14: mol_type = other DNA
tcagtgctgcgctg

SEQ ID NO: 7427 - DNA, 14 bp, synthetic construct
  source 1..14: mol_type = other DNA
cgggactagttata

SEQ ID NO: 7428 - DNA, 14 bp, synthetic construct
  source 1..14: mol_type = other DNA
atgtcccccttaaa

SEQ ID NO: 7429 - DNA, 14 bp, synthetic construct
  source 1..14: mol_type = other DNA
tgccgatgtgacgt

SEQ ID NO: 7430 - DNA, 14 bp, synthetic construct
  source 1..14: mol_type = other DNA
tgctaaatggcgct

SEQ ID NO: 7431 - DNA, 14 bp, synthetic construct
  source 1..14: mol_type = other DNA
atccctaaaacttg

SEQ ID NO: 7432 - DNA, 14 bp, synthetic construct
  source 1..14: mol_type = other DNA
ccagatacgttatc

SEQ ID NO: 7433 - DNA, 14 bp, synthetic construct
  source 1..14: mol_type = other DNA
cggctataaaatgt

SEQ ID NO: 7434 - DNA, 14 bp, synthetic construct
  source 1..14: mol_type = other DNA
ctgcgaatctaatc

SEQ ID NO: 7435 - DNA, 14 bp, synthetic construct
  source 1..14: mol_type = other DNA
atacacattctaca

SEQ ID NO: 7436 - DNA, 14 bp, synthetic construct
  source 1..14: mol_type = other DNA
tcctaggcttaaag

SEQ ID NO: 7437 - DNA, 14 bp, synthetic construct
  source 1..14: mol_type = other DNA
gtatacaagtgtag

SEQ ID NO: 7438 - DNA, 14 bp, synthetic construct
  source 1..14: mol_type = other DNA
agagtcatactagt

SEQ ID NO: 7439 - DNA, 14 bp, synthetic construct
  source 1..14: mol_type = other DNA
tccctccattgggg

SEQ ID NO: 7440 - DNA, 14 bp, synthetic construct
  source 1..14: mol_type = other DNA
ttgacattaccgag

SEQ ID NO: 7441 - DNA, 14 bp, synthetic construct
  source 1..14: mol_type = other DNA
taagggtatgtcga

SEQ ID NO: 7442 - DNA, 14 bp, synthetic construct
  source 1..14: mol_type = other DNA
atgtgcttgcacgc

SEQ ID NO: 7443 - DNA, 14 bp, synthetic construct
  source 1..14: mol_type = other DNA
gctctagaacttag

SEQ ID NO: 7444 - DNA, 14 bp, synthetic construct
  source 1..14: mol_type = other DNA
tactaccctggtgg

SEQ ID NO: 7445 - DNA, 14 bp, synthetic construct
  source 1..14: mol_type = other DNA
taaattcacgaagt

SEQ ID NO: 7446 - DNA, 14 bp, synthetic construct
  source 1..14: mol_type = other DNA
ccctgctggcttgg

SEQ ID NO: 7447 - DNA, 14 bp, synthetic construct
  source 1..14: mol_type = other DNA
gggttcgccttgcg

SEQ ID NO: 7448 - DNA, 14 bp, synthetic construct
  source 1..14: mol_type = other DNA
tgtctggctggagc

SEQ ID NO: 7449 - DNA, 14 bp, synthetic construct
  source 1..14: mol_type = other DNA
acattctctggcgc

SEQ ID NO: 7450 - DNA, 14 bp, synthetic construct
  source 1..14: mol_type = other DNA
gaagttactcacat

SEQ ID NO: 7451 - DNA, 14 bp, synthetic construct
  source 1..14: mol_type = other DNA
gcgatttgatcccg

SEQ ID NO: 7452 - DNA, 14 bp, synthetic construct
  source 1..14: mol_type = other DNA
ccataggtccattc

SEQ ID NO: 7453 - DNA, 14 bp, synthetic construct
  source 1..14: mol_type = other DNA
atcgcagcttcata

SEQ ID NO: 7454 - DNA, 14 bp, synthetic construct
  source 1..14: mol_type = other DNA
gtagctctcctgaa

SEQ ID NO: 7455 - DNA, 14 bp, synthetic construct
  source 1..14: mol_type = other DNA
catgatggccctgt

SEQ ID NO: 7456 - DNA, 14 bp, synthetic construct
  source 1..14: mol_type = other DNA
agtcgtttcaccaa

SEQ ID NO: 7457 - DNA, 14 bp, synthetic construct
  source 1..14: mol_type = other DNA
tccaatcggtaggt

SEQ ID NO: 7458 - DNA, 14 bp, synthetic construct
  source 1..14: mol_type = other DNA
agtcggtgtcatcc

SEQ ID NO: 7459 - DNA, 14 bp, synthetic construct
  source 1..14: mol_type = other DNA
aggctttcagcata

SEQ ID NO: 7460 - DNA, 14 bp, synthetic construct
  source 1..14: mol_type = other DNA
tttataagacgcag

SEQ ID NO: 7461 - DNA, 14 bp, synthetic construct
  source 1..14: mol_type = other DNA
ctggcctctatgca

SEQ ID NO: 7462 - DNA, 14 bp, synthetic construct
  source 1..14: mol_type = other DNA
gcgtttgcgggtcg

SEQ ID NO: 7463 - DNA, 14 bp, synthetic construct
  source 1..14: mol_type = other DNA
ggattttcggaggc

SEQ ID NO: 7464 - DNA, 14 bp, synthetic construct
  source 1..14: mol_type = other DNA
tgctggtatggaca

SEQ ID NO: 7465 - DNA, 14 bp, synthetic construct
  source 1..14: mol_type = other DNA
gtttggacaataac

SEQ ID NO: 7466 - DNA, 14 bp, synthetic construct
  source 1..14: mol_type = other DNA
gcggcatgcattgt

SEQ ID NO: 7467 - DNA, 14 bp, synthetic construct
  source 1..14: mol_type = other DNA
ttcagtgccatgga

SEQ ID NO: 7468 - DNA, 14 bp, synthetic construct
  source 1..14: mol_type = other DNA
gcagagtaatttca

SEQ ID NO: 7469 - DNA, 14 bp, synthetic construct
  source 1..14: mol_type = other DNA
tctacaaacgtcat

SEQ ID NO: 7470 - DNA, 14 bp, synthetic construct
  source 1..14: mol_type = other DNA
ctgccgacgaattt

SEQ ID NO: 7471 - DNA, 14 bp, synthetic construct
  source 1..14: mol_type = other DNA
cttgcacggctaat

SEQ ID NO: 7472 - DNA, 14 bp, synthetic construct
  source 1..14: mol_type = other DNA
acgtgtcccatgct

SEQ ID NO: 7473 - DNA, 14 bp, synthetic construct
  source 1..14: mol_type = other DNA
tcatccaacaggtt

SEQ ID NO: 7474 - DNA, 14 bp, synthetic construct
  source 1..14: mol_type = other DNA
actgtgaccctctg

SEQ ID NO: 7475 - DNA, 14 bp, synthetic construct
  source 1..14: mol_type = other DNA
acggctttcgccta

SEQ ID NO: 7476 - DNA, 14 bp, synthetic construct
  source 1..14: mol_type = other DNA
tgattatcgacagg

SEQ ID NO: 7477 - DNA, 14 bp, synthetic construct
  source 1..14: mol_type = other DNA
cccaatatttacag

SEQ ID NO: 7478 - DNA, 14 bp, synthetic construct
  source 1..14: mol_type = other DNA
gtcatgtacataag

SEQ ID NO: 7479 - DNA, 14 bp, synthetic construct
  source 1..14: mol_type = other DNA
ccaccgactctttg

SEQ ID NO: 7480 - DNA, 14 bp, synthetic construct
  source 1..14: mol_type = other DNA
cacctcgtcttggc

SEQ ID NO: 7481 - DNA, 14 bp, synthetic construct
  source 1..14: mol_type = other DNA
agtagattgcagtc

SEQ ID NO: 7482 - DNA, 14 bp, synthetic construct
  source 1..14: mol_type = other DNA
gtacgctccgtcta

SEQ ID NO: 7483 - DNA, 14 bp, synthetic construct
  source 1..14: mol_type = other DNA
cgcgctgttcgcta

SEQ ID NO: 7484 - DNA, 14 bp, synthetic construct
  source 1..14: mol_type = other DNA
ccccaggattgtct

SEQ ID NO: 7485 - DNA, 14 bp, synthetic construct
  source 1..14: mol_type = other DNA
tctgacggtacatg

SEQ ID NO: 7486 - DNA, 14 bp, synthetic construct
  source 1..14: mol_type = other DNA
gcctgaactttcgc

SEQ ID NO: 7487 - DNA, 14 bp, synthetic construct
  source 1..14: mol_type = other DNA
cgcgtctataggtg

SEQ ID NO: 7488 - DNA, 14 bp, synthetic construct
  source 1..14: mol_type = other DNA
aagaatggcttgct

SEQ ID NO: 7489 - DNA, 14 bp, synthetic construct
  source 1..14: mol_type = other DNA
gtgagcaggccttt

SEQ ID NO: 7490 - DNA, 14 bp, synthetic construct
  source 1..14: mol_type = other DNA
ctacttagtgcgcc

SEQ ID NO: 7491 - DNA, 14 bp, synthetic construct
  source 1..14: mol_type = other DNA
acgtgtgacttaaa

SEQ ID NO: 7492 - DNA, 14 bp, synthetic construct
  source 1..14: mol_type = other DNA
taactacattccgc

SEQ ID NO: 7493 - DNA, 14 bp, synthetic construct
  source 1..14: mol_type = other DNA
ctgagccctgtgat

SEQ ID NO: 7494 - DNA, 14 bp, synthetic construct
  source 1..14: mol_type = other DNA
catcggatgctcat

SEQ ID NO: 7495 - DNA, 14 bp, synthetic construct
  source 1..14: mol_type = other DNA
cgtgtccctgggtc

SEQ ID NO: 7496 - DNA, 14 bp, synthetic construct
  source 1..14: mol_type = other DNA
aatatgggtagatc

SEQ ID NO: 7497 - DNA, 14 bp, synthetic construct
  source 1..14: mol_type = other DNA
gcggtgatgctcgt

SEQ ID NO: 7498 - DNA, 14 bp, synthetic construct
  source 1..14: mol_type = other DNA
ggcctgctatatcc

SEQ ID NO: 7499 - DNA, 14 bp, synthetic construct
  source 1..14: mol_type = other DNA
ttcgcacagagtta

SEQ ID NO: 7500 - DNA, 14 bp, synthetic construct
  source 1..14: mol_type = other DNA
ttgacacctgagtg

SEQ ID NO: 7501 - DNA, 14 bp, synthetic construct
  source 1..14: mol_type = other DNA
cacgctagtatgta

SEQ ID NO: 7502 - DNA, 14 bp, synthetic construct
  source 1..14: mol_type = other DNA
aagtctcgtcggta

SEQ ID NO: 7503 - DNA, 14 bp, synthetic construct
  source 1..14: mol_type = other DNA
gggtatccccctct

SEQ ID NO: 7504 - DNA, 14 bp, synthetic construct
  source 1..14: mol_type = other DNA
tagttcaaaagatg

SEQ ID NO: 7505 - DNA, 14 bp, synthetic construct
  source 1..14: mol_type = other DNA
caacaaattttgga

SEQ ID NO: 7506 - DNA, 14 bp, synthetic construct
  source 1..14: mol_type = other DNA
gtggtgagatatgc

SEQ ID NO: 7507 - DNA, 14 bp, synthetic construct
  source 1..14: mol_type = other DNA
gaaactgtcatgtc

SEQ ID NO: 7508 - DNA, 14 bp, synthetic construct
  source 1..14: mol_type = other DNA
gtccgggatcgtat

SEQ ID NO: 7509 - DNA, 14 bp, synthetic construct
  source 1..14: mol_type = other DNA
ggtgaagtgatgtg

SEQ ID NO: 7510 - DNA, 14 bp, synthetic construct
  source 1..14: mol_type = other DNA
cacttcgagacctt

SEQ ID NO: 7511 - DNA, 14 bp, synthetic construct
  source 1..14: mol_type = other DNA
ttatgggcgtgcca

SEQ ID NO: 7512 - DNA, 14 bp, synthetic construct
  source 1..14: mol_type = other DNA
ctgaacgtgccttc

SEQ ID NO: 7513 - DNA, 14 bp, synthetic construct
  source 1..14: mol_type = other DNA
catagtggcgaatt

SEQ ID NO: 7514 - DNA, 14 bp, synthetic construct
  source 1..14: mol_type = other DNA
ccaatgctggtagt

SEQ ID NO: 7515 - DNA, 14 bp, synthetic construct
  source 1..14: mol_type = other DNA
cgtttaagaggcat

SEQ ID NO: 7516 - DNA, 14 bp, synthetic construct
  source 1..14: mol_type = other DNA
gcattctcggcgtg

SEQ ID NO: 7517 - DNA, 14 bp, synthetic construct
  source 1..14: mol_type = other DNA
aagagcttactcct

SEQ ID NO: 7518 - DNA, 14 bp, synthetic construct
  source 1..14: mol_type = other DNA
cccctttcgctcca

SEQ ID NO: 7519 - DNA, 14 bp, synthetic construct
  source 1..14: mol_type = other DNA
gccactctgtgtgg

SEQ ID NO: 7520 - DNA, 14 bp, synthetic construct
  source 1..14: mol_type = other DNA
gagggtataatgct

SEQ ID NO: 7521 - DNA, 14 bp, synthetic construct
  source 1..14: mol_type = other DNA
caattgctcgatga

SEQ ID NO: 7522 - DNA, 14 bp, synthetic construct
  source 1..14: mol_type = other DNA
taaccttcgagatg

SEQ ID NO: 7523 - DNA, 14 bp, synthetic construct
  source 1..14: mol_type = other DNA
cggcatttacgctc

SEQ ID NO: 7524 - DNA, 14 bp, synthetic construct
  source 1..14: mol_type = other DNA
gggttccgttgccc

SEQ ID NO: 7525 - DNA, 14 bp, synthetic construct
  source 1..14: mol_type = other DNA
tgtagaggtcacta

SEQ ID NO: 7526 - DNA, 14 bp, synthetic construct
  source 1..14: mol_type = other DNA
tgttgaaccgggtg

SEQ ID NO: 7527 - DNA, 14 bp, synthetic construct
  source 1..14: mol_type = other DNA
gatctggagttgac

SEQ ID NO: 7528 - DNA, 14 bp, synthetic construct
  source 1..14: mol_type = other DNA
ctggcgtgtgtagg

SEQ ID NO: 7529 - DNA, 14 bp, synthetic construct
  source 1..14: mol_type = other DNA
tgcgtgcgtcggtc

SEQ ID NO: 7530 - DNA, 14 bp, synthetic construct
  source 1..14: mol_type = other DNA
tgaccacaattgtg

SEQ ID NO: 7531 - DNA, 14 bp, synthetic construct
  source 1..14: mol_type = other DNA
actccaatagctct

SEQ ID NO: 7532 - DNA, 14 bp, synthetic construct
  source 1..14: mol_type = other DNA
cgtatcatcaatac

SEQ ID NO: 7533 - DNA, 14 bp, synthetic construct
  source 1..14: mol_type = other DNA
cttgacgctacagt

SEQ ID NO: 7534 - DNA, 14 bp, synthetic construct
  source 1..14: mol_type = other DNA
tgaggcttaaatag

SEQ ID NO: 7535 - DNA, 14 bp, synthetic construct
  source 1..14: mol_type = other DNA
cttgaattgaagca

SEQ ID NO: 7536 - DNA, 14 bp, synthetic construct
  source 1..14: mol_type = other DNA
gcagcacgtttcta

SEQ ID NO: 7537 - DNA, 14 bp, synthetic construct
  source 1..14: mol_type = other DNA
gttgtgcccaaatc

SEQ ID NO: 7538 - DNA, 14 bp, synthetic construct
  source 1..14: mol_type = other DNA
aggtcaccggtttg

SEQ ID NO: 7539 - DNA, 14 bp, synthetic construct
  source 1..14: mol_type = other DNA
ggtaatgacgcgtt

SEQ ID NO: 7540 - DNA, 14 bp, synthetic construct
  source 1..14: mol_type = other DNA
agcttaggcttccc

SEQ ID NO: 7541 - DNA, 14 bp, synthetic construct
  source 1..14: mol_type = other DNA
aacgttagctatag

SEQ ID NO: 7542 - DNA, 14 bp, synthetic construct
  source 1..14: mol_type = other DNA
aatgatagtcgctc

SEQ ID NO: 7543 - DNA, 14 bp, synthetic construct
  source 1..14: mol_type = other DNA
gccacgttcgttac

SEQ ID NO: 7544 - DNA, 14 bp, synthetic construct
  source 1..14: mol_type = other DNA
ggtcctcgcatctc

SEQ ID NO: 7545 - DNA, 14 bp, synthetic construct
  source 1..14: mol_type = other DNA
tcctttacaccggc

SEQ ID NO: 7546 - DNA, 14 bp, synthetic construct
  source 1..14: mol_type = other DNA
agtattctgagaaa

SEQ ID NO: 7547 - DNA, 14 bp, synthetic construct
  source 1..14: mol_type = other DNA
gactcttcggatgg

SEQ ID NO: 7548 - DNA, 14 bp, synthetic construct
  source 1..14: mol_type = other DNA
cgcgcatgattact

SEQ ID NO: 7549 - DNA, 14 bp, synthetic construct
  source 1..14: mol_type = other DNA
ctgcggcttgctaa

SEQ ID NO: 7550 - DNA, 14 bp, synthetic construct
  source 1..14: mol_type = other DNA
ctagaattagagtc

SEQ ID NO: 7551 - DNA, 14 bp, synthetic construct
  source 1..14: mol_type = other DNA
agcgtctgttgagc

SEQ ID NO: 7552 - DNA, 14 bp, synthetic construct
  source 1..14: mol_type = other DNA
tatcttagacaagg

SEQ ID NO: 7553 - DNA, 14 bp, synthetic construct
  source 1..14: mol_type = other DNA
tatgcacccaatgt

SEQ ID NO: 7554 - DNA, 14 bp, synthetic construct
  source 1..14: mol_type = other DNA
tgaagagaattgat

SEQ ID NO: 7555 - DNA, 14 bp, synthetic construct
  source 1..14: mol_type = other DNA
tgcggtcgaacttg

SEQ ID NO: 7556 - DNA, 14 bp, synthetic construct
  source 1..14: mol_type = other DNA
gatcttgaaggtgg

SEQ ID NO: 7557 - DNA, 14 bp, synthetic construct
  source 1..14: mol_type = other DNA
cactatcatatccg

SEQ ID NO: 7558 - DNA, 14 bp, synthetic construct
  source 1..14: mol_type = other DNA
ctgcacatttcgcg

SEQ ID NO: 7559 - DNA, 14 bp, synthetic construct
  source 1..14: mol_type = other DNA
tcttaagggaactg

SEQ ID NO: 7560 - DNA, 14 bp, synthetic construct
  source 1..14: mol_type = other DNA
tgggttccggacct

SEQ ID NO: 7561 - DNA, 14 bp, synthetic construct
  source 1..14: mol_type = other DNA
tgtacggtgctacg

SEQ ID NO: 7562 - DNA, 14 bp, synthetic construct
  source 1..14: mol_type = other DNA
atagcgtctaaact

SEQ ID NO: 7563 - DNA, 14 bp, synthetic construct
  source 1..14: mol_type = other DNA
gagtgtattggcga

SEQ ID NO: 7564 - DNA, 14 bp, synthetic construct
  source 1..14: mol_type = other DNA
gatgtactcctcaa

SEQ ID NO: 7565 - DNA, 14 bp, synthetic construct
  source 1..14: mol_type = other DNA
ctgtcctcatccgg

SEQ ID NO: 7566 - DNA, 14 bp, synthetic construct
  source 1..14: mol_type = other DNA
aaggaattgttcaa

SEQ ID NO: 7567 - DNA, 14 bp, synthetic construct
  source 1..14: mol_type = other DNA
cgtttacactcccg

SEQ ID NO: 7568 - DNA, 14 bp, synthetic construct
  source 1..14: mol_type = other DNA
atcggtagccttga

SEQ ID NO: 7569 - DNA, 14 bp, synthetic construct
  source 1..14: mol_type = other DNA
agtagtcaacttgg

SEQ ID NO: 7570 - DNA, 14 bp, synthetic construct
  source 1..14: mol_type = other DNA
tctctagagtacca

SEQ ID NO: 7571 - DNA, 14 bp, synthetic construct
  source 1..14: mol_type = other DNA
tctgccatcgagtg

SEQ ID NO: 7572 - DNA, 14 bp, synthetic construct
  source 1..14: mol_type = other DNA
ttaactcaggccta

SEQ ID NO: 7573 - DNA, 14 bp, synthetic construct
  source 1..14: mol_type = other DNA
tagctggggagttg

SEQ ID NO: 7574 - DNA, 14 bp, synthetic construct
  source 1..14: mol_type = other DNA
atccgtaatgcggt

SEQ ID NO: 7575 - DNA, 14 bp, synthetic construct
  source 1..14: mol_type = other DNA
tatatgacgggtcc

SEQ ID NO: 7576 - DNA, 14 bp, synthetic construct
  source 1..14: mol_type = other DNA
gatcagtgtacact

SEQ ID NO: 7577 - DNA, 14 bp, synthetic construct
  source 1..14: mol_type = other DNA
tgagtaaactaatc

SEQ ID NO: 7578 - DNA, 14 bp, synthetic construct
  source 1..14: mol_type = other DNA
ctcacctcgatcct

SEQ ID NO: 7579 - DNA, 14 bp, synthetic construct
  source 1..14: mol_type = other DNA
acgttaatacctgc

SEQ ID NO: 7580 - DNA, 14 bp, synthetic construct
  source 1..14: mol_type = other DNA
tcctaagtaatgcg

SEQ ID NO: 7581 - DNA, 14 bp, synthetic construct
  source 1..14: mol_type = other DNA
tagtgcgcgactat

SEQ ID NO: 7582 - DNA, 14 bp, synthetic construct
  source 1..14: mol_type = other DNA
tacgttcccagaat

SEQ ID NO: 7583 - DNA, 14 bp, synthetic construct
  source 1..14: mol_type = other DNA
tccttggatgaagc

SEQ ID NO: 7584 - DNA, 14 bp, synthetic construct
  source 1..14: mol_type = other DNA
atctccatacactg

SEQ ID NO: 7585 - DNA, 14 bp, synthetic construct
  source 1..14: mol_type = other DNA
cggcctatgtgcat

SEQ ID NO: 7586 - DNA, 14 bp, synthetic construct
  source 1..14: mol_type = other DNA
gatccctctgtgca

SEQ ID NO: 7587 - DNA, 14 bp, synthetic construct
  source 1..14: mol_type = other DNA
agctttgaactagg

SEQ ID NO: 7588 - DNA, 14 bp, synthetic construct
  source 1..14: mol_type = other DNA
tgcaagttgcgata

SEQ ID NO: 7589 - DNA, 14 bp, synthetic construct
  source 1..14: mol_type = other DNA
tatcctgtcggggc

SEQ ID NO: 7590 - DNA, 14 bp, synthetic construct
  source 1..14: mol_type = other DNA
taaaaactacactt

SEQ ID NO: 7591 - DNA, 14 bp, synthetic construct
  source 1..14: mol_type = other DNA
ttggtacggcgtag

SEQ ID NO: 7592 - DNA, 14 bp, synthetic construct
  source 1..14: mol_type = other DNA
gtagaagtcttagc

SEQ ID NO: 7593 - DNA, 14 bp, synthetic construct
  source 1..14: mol_type = other DNA
cgatatcacgttaa

SEQ ID NO: 7594 - DNA, 14 bp, synthetic construct
  source 1..14: mol_type = other DNA
attaggataggtga

SEQ ID NO: 7595 - DNA, 14 bp, synthetic construct
  source 1..14: mol_type = other DNA
actgaccgatttac

SEQ ID NO: 7596 - DNA, 14 bp, synthetic construct
  source 1..14: mol_type = other DNA
catagattgatccg

SEQ ID NO: 7597 - DNA, 14 bp, synthetic construct
  source 1..14: mol_type = other DNA
ctcttgctcaagcc

SEQ ID NO: 7598 - DNA, 14 bp, synthetic construct
  source 1..14: mol_type = other DNA
ctgcttccgtaagc

SEQ ID NO: 7599 - DNA, 14 bp, synthetic construct
  source 1..14: mol_type = other DNA
tagtacactaataa

SEQ ID NO: 7600 - DNA, 14 bp, synthetic construct
  source 1..14: mol_type = other DNA
catttggctaagcc

SEQ ID NO: 7601 - DNA, 14 bp, synthetic construct
  source 1..14: mol_type = other DNA
ccgttactcgctag

SEQ ID NO: 7602 - DNA, 14 bp, synthetic construct
  source 1..14: mol_type = other DNA
ctcggattgcagat

SEQ ID NO: 7603 - DNA, 14 bp, synthetic construct
  source 1..14: mol_type = other DNA
ctgcctagtgggat

SEQ ID NO: 7604 - DNA, 14 bp, synthetic construct
  source 1..14: mol_type = other DNA
cactttcgggcgat

SEQ ID NO: 7605 - DNA, 14 bp, synthetic construct
  source 1..14: mol_type = other DNA
ccgtttggtgggca

SEQ ID NO: 7606 - DNA, 14 bp, synthetic construct
  source 1..14: mol_type = other DNA
gcgggatgattctg

SEQ ID NO: 7607 - DNA, 14 bp, synthetic construct
  source 1..14: mol_type = other DNA
cagtctcgtgctag

SEQ ID NO: 7608 - DNA, 14 bp, synthetic construct
  source 1..14: mol_type = other DNA
acttgtctgaacaa

SEQ ID NO: 7609 - DNA, 14 bp, synthetic construct
  source 1..14: mol_type = other DNA
gactctcgtatcga

SEQ ID NO: 7610 - DNA, 14 bp, synthetic construct
  source 1..14: mol_type = other DNA
aagattgattacgc

SEQ ID NO: 7611 - DNA, 14 bp, synthetic construct
  source 1..14: mol_type = other DNA
accttaattggcca

SEQ ID NO: 7612 - DNA, 14 bp, synthetic construct
  source 1..14: mol_type = other DNA
tataacaagagttg

SEQ ID NO: 7613 - DNA, 14 bp, synthetic construct
  source 1..14: mol_type = other DNA
ttaggtgacactcc

SEQ ID NO: 7614 - DNA, 14 bp, synthetic construct
  source 1..14: mol_type = other DNA
tttcacgagcggtg

SEQ ID NO: 7615 - DNA, 14 bp, synthetic construct
  source 1..14: mol_type = other DNA
ccacggaggttctt

SEQ ID NO: 7616 - DNA, 14 bp, synthetic construct
  source 1..14: mol_type = other DNA
tatcccttgaaacc

SEQ ID NO: 7617 - DNA, 14 bp, synthetic construct
  source 1..14: mol_type = other DNA
tggtcaagtggtcg

SEQ ID NO: 7618 - DNA, 14 bp, synthetic construct
  source 1..14: mol_type = other DNA
ggggtttgtcgccg

SEQ ID NO: 7619 - DNA, 14 bp, synthetic construct
  source 1..14: mol_type = other DNA
gatatcctaaggtg

SEQ ID NO: 7620 - DNA, 14 bp, synthetic construct
  source 1..14: mol_type = other DNA
aatcgcgctaaatt

SEQ ID NO: 7621 - DNA, 14 bp, synthetic construct
  source 1..14: mol_type = other DNA
atacgtgaatgcgt

SEQ ID NO: 7622 - DNA, 14 bp, synthetic construct
  source 1..14: mol_type = other DNA
gataacctctaggt

SEQ ID NO: 7623 - DNA, 14 bp, synthetic construct
  source 1..14: mol_type = other DNA
atcctcagttcggc

SEQ ID NO: 7624 - DNA, 14 bp, synthetic construct
  source 1..14: mol_type = other DNA
gtatggagcgttac

SEQ ID NO: 7625 - DNA, 14 bp, synthetic construct
  source 1..14: mol_type = other DNA
gactcttcgaggtc

SEQ ID NO: 7626 - DNA, 14 bp, synthetic construct
  source 1..14: mol_type = other DNA
gatcatagaagttc

SEQ ID NO: 7627 - DNA, 14 bp, synthetic construct
  source 1..14: mol_type = other DNA
atccacacttctaa

SEQ ID NO: 7628 - DNA, 14 bp, synthetic construct
  source 1..14: mol_type = other DNA
gtttcgtgagaaaa

SEQ ID NO: 7629 - DNA, 14 bp, synthetic construct
  source 1..14: mol_type = other DNA
tggggataattccc

SEQ ID NO: 7630 - DNA, 14 bp, synthetic construct
  source 1..14: mol_type = other DNA
tacagttactagag

SEQ ID NO: 7631 - DNA, 14 bp, synthetic construct
  source 1..14: mol_type = other DNA
gccgttagccatct

SEQ ID NO: 7632 - DNA, 14 bp, synthetic construct
  source 1..14: mol_type = other DNA
cgagggtttatagg

SEQ ID NO: 7633 - DNA, 14 bp, synthetic construct
  source 1..14: mol_type = other DNA
atcctgagtgctcg

SEQ ID NO: 7634 - DNA, 14 bp, synthetic construct
  source 1..14: mol_type = other DNA
aacgttttcggaga

SEQ ID NO: 7635 - DNA, 14 bp, synthetic construct
  source 1..14: mol_type = other DNA
ttacctcggggcgt

SEQ ID NO: 7636 - DNA, 14 bp, synthetic construct
  source 1..14: mol_type = other DNA
ttgaggagaagtat

SEQ ID NO: 7637 - DNA, 14 bp, synthetic construct
  source 1..14: mol_type = other DNA
actctataacctga

SEQ ID NO: 7638 - DNA, 14 bp, synthetic construct
  source 1..14: mol_type = other DNA
ttatcgctacacaa

SEQ ID NO: 7639 - DNA, 14 bp, synthetic construct
  source 1..14: mol_type = other DNA
aatcatcgggtcgt

SEQ ID NO: 7640 - DNA, 14 bp, synthetic construct
  source 1..14: mol_type = other DNA
tggagcacgttgct

SEQ ID NO: 7641 - DNA, 14 bp, synthetic construct
  source 1..14: mol_type = other DNA
tcattaggtaagag

SEQ ID NO: 7642 - DNA, 14 bp, synthetic construct
  source 1..14: mol_type = other DNA
gcctgcattccctg

SEQ ID NO: 7643 - DNA, 14 bp, synthetic construct
  source 1..14: mol_type = other DNA
ttttggagaagaca

SEQ ID NO: 7644 - DNA, 14 bp, synthetic construct
  source 1..14: mol_type = other DNA
ctttcgagagacct

SEQ ID NO: 7645 - DNA, 14 bp, synthetic construct
  source 1..14: mol_type = other DNA
tgctaggtatcccc

SEQ ID NO: 7646 - DNA, 14 bp, synthetic construct
  source 1..14: mol_type = other DNA
atcgtccgttcccg

SEQ ID NO: 7647 - DNA, 14 bp, synthetic construct
  source 1..14: mol_type = other DNA
atcgctcccgtact

SEQ ID NO: 7648 - DNA, 14 bp, synthetic construct
  source 1..14: mol_type = other DNA
tgtataagaaacgt

SEQ ID NO: 7649 - DNA, 14 bp, synthetic construct
  source 1..14: mol_type = other DNA
ggcacgcttgtact

SEQ ID NO: 7650 - DNA, 14 bp, synthetic construct
  source 1..14: mol_type = other DNA
taatagttgcgaac

SEQ ID NO: 7651 - DNA, 14 bp, synthetic construct
  source 1..14: mol_type = other DNA
tctatcattcgaac

SEQ ID NO: 7652 - DNA, 14 bp, synthetic construct
  source 1..14: mol_type = other DNA
gactccgtgttact

SEQ ID NO: 7653 - DNA, 14 bp, synthetic construct
  source 1..14: mol_type = other DNA
ctagtaatggtatc

SEQ ID NO: 7654 - DNA, 14 bp, synthetic construct
  source 1..14: mol_type = other DNA
acggtctattcgtc

SEQ ID NO: 7655 - DNA, 14 bp, synthetic construct
  source 1..14: mol_type = other DNA
cgagtgctctcctt

SEQ ID NO: 7656 - DNA, 14 bp, synthetic construct
  source 1..14: mol_type = other DNA
gtggattcacatgt

SEQ ID NO: 7657 - DNA, 14 bp, synthetic construct
  source 1..14: mol_type = other DNA
ttactgtggctaga

SEQ ID NO: 7658 - DNA, 14 bp, synthetic construct
  source 1..14: mol_type = other DNA
atttaaagtcagtc

SEQ ID NO: 7659 - DNA, 14 bp, synthetic construct
  source 1..14: mol_type = other DNA
catcatcttcatcg

SEQ ID NO: 7660 - DNA, 14 bp, synthetic construct
  source 1..14: mol_type = other DNA
tatagaagtgcatt

SEQ ID NO: 7661 - DNA, 14 bp, synthetic construct
  source 1..14: mol_type = other DNA
tctggagtctcgtc

SEQ ID NO: 7662 - DNA, 14 bp, synthetic construct
  source 1..14: mol_type = other DNA
tatccacggtgtgt

SEQ ID NO: 7663 - DNA, 14 bp, synthetic construct
  source 1..14: mol_type = other DNA
tatgtccggctcat

SEQ ID NO: 7664 - DNA, 14 bp, synthetic construct
  source 1..14: mol_type = other DNA
agtttataaggact

SEQ ID NO: 7665 - DNA, 14 bp, synthetic construct
  source 1..14: mol_type = other DNA
cgagtgtttcgata

SEQ ID NO: 7666 - DNA, 14 bp, synthetic construct
  source 1..14: mol_type = other DNA
tgttactcaataac

SEQ ID NO: 7667 - DNA, 14 bp, synthetic construct
  source 1..14: mol_type = other DNA
acagtttccatcta

SEQ ID NO: 7668 - DNA, 14 bp, synthetic construct
  source 1..14: mol_type = other DNA
gtacaatgcccttt

SEQ ID NO: 7669 - DNA, 14 bp, synthetic construct
  source 1..14: mol_type = other DNA
taagtagatctatg

SEQ ID NO: 7670 - DNA, 14 bp, synthetic construct
  source 1..14: mol_type = other DNA
cctaattttggggc

SEQ ID NO: 7671 - DNA, 14 bp, synthetic construct
  source 1..14: mol_type = other DNA
ctcatatgcgtagt

SEQ ID NO: 7672 - DNA, 14 bp, synthetic construct
  source 1..14: mol_type = other DNA
gcttgcgtctgtgg

SEQ ID NO: 7673 - DNA, 14 bp, synthetic construct
  source 1..14: mol_type = other DNA
aatgacattacttc

SEQ ID NO: 7674 - DNA, 14 bp, synthetic construct
  source 1..14: mol_type = other DNA
cgtgaatatccgtt

SEQ ID NO: 7675 - DNA, 14 bp, synthetic construct
  source 1..14: mol_type = other DNA
cgttagcgactttg

SEQ ID NO: 7676 - DNA, 14 bp, synthetic construct
  source 1..14: mol_type = other DNA
tctattgtgcagca

SEQ ID NO: 7677 - DNA, 14 bp, synthetic construct
  source 1..14: mol_type = other DNA
gataagaggttatt

SEQ ID NO: 7678 - DNA, 14 bp, synthetic construct
  source 1..14: mol_type = other DNA
cgcttctacatagt

SEQ ID NO: 7679 - DNA, 14 bp, synthetic construct
  source 1..14: mol_type = other DNA
agggtccttagtat

SEQ ID NO: 7680 - DNA, 14 bp, synthetic construct
  source 1..14: mol_type = other DNA
tactgtaacgtagt

SEQ ID NO: 7681 - DNA, 14 bp, synthetic construct
  source 1..14: mol_type = other DNA
catgttgagatggt

SEQ ID NO: 7682 - DNA, 14 bp, synthetic construct
  source 1..14: mol_type = other DNA
acacatttattgcc

SEQ ID NO: 7683 - DNA, 14 bp, synthetic construct
  source 1..14: mol_type = other DNA
tctgggccttgctc

SEQ ID NO: 7684 - DNA, 14 bp, synthetic construct
  source 1..14: mol_type = other DNA
gcaatatttctagg

SEQ ID NO: 7685 - DNA, 14 bp, synthetic construct
  source 1..14: mol_type = other DNA
actagtctgattcc

SEQ ID NO: 7686 - DNA, 14 bp, synthetic construct
  source 1..14: mol_type = other DNA
ccaatgaagtattt

SEQ ID NO: 7687 - DNA, 14 bp, synthetic construct
  source 1..14: mol_type = other DNA
gcgaaatatttcgt

SEQ ID NO: 7688 - DNA, 14 bp, synthetic construct
  source 1..14: mol_type = other DNA
tattatccaactgc

SEQ ID NO: 7689 - DNA, 14 bp, synthetic construct
  source 1..14: mol_type = other DNA
tcttttagcacccc

SEQ ID NO: 7690 - DNA, 14 bp, synthetic construct
  source 1..14: mol_type = other DNA
ttttaaggataggc

SEQ ID NO: 7691 - DNA, 14 bp, synthetic construct
  source 1..14: mol_type = other DNA
cgtaacgctgtgtt

SEQ ID NO: 7692 - DNA, 14 bp, synthetic construct
  source 1..14: mol_type = other DNA
ctaaacatttcatc

SEQ ID NO: 7693 - DNA, 14 bp, synthetic construct
  source 1..14: mol_type = other DNA
gaagttctactata

SEQ ID NO: 7694 - DNA, 14 bp, synthetic construct
  source 1..14: mol_type = other DNA
gctggtatgttcgg

SEQ ID NO: 7695 - DNA, 14 bp, synthetic construct
  source 1..14: mol_type = other DNA
tcggatacgatttg

SEQ ID NO: 7696 - DNA, 14 bp, synthetic construct
  source 1..14: mol_type = other DNA
ctaaagttgtctac

SEQ ID NO: 7697 - DNA, 14 bp, synthetic construct
  source 1..14: mol_type = other DNA
tcccattctgaaat

SEQ ID NO: 7698 - DNA, 14 bp, synthetic construct
  source 1..14: mol_type = other DNA
atagcttgatggat

SEQ ID NO: 7699 - DNA, 14 bp, synthetic construct
  source 1..14: mol_type = other DNA
gtatcaatggttgg

SEQ ID NO: 7700 - DNA, 14 bp, synthetic construct
  source 1..14: mol_type = other DNA
caagtctcttggta

SEQ ID NO: 7701 - DNA, 14 bp, synthetic construct
  source 1..14: mol_type = other DNA
gttgatagttaaga

SEQ ID NO: 7702 - DNA, 14 bp, synthetic construct
  source 1..14: mol_type = other DNA
gtttaacatccctg

SEQ ID NO: 7703 - DNA, 14 bp, synthetic construct
  source 1..14: mol_type = other DNA
ggtcgagactgttt

SEQ ID NO: 7704 - DNA, 14 bp, synthetic construct
  source 1..14: mol_type = other DNA
ttgcgcgtatggtg

SEQ ID NO: 7705 - DNA, 14 bp, synthetic construct
  source 1..14: mol_type = other DNA
ttgctgatcgaata

SEQ ID NO: 7706 - DNA, 14 bp, synthetic construct
  source 1..14: mol_type = other DNA
gggtctttgagaat

SEQ ID NO: 7707 - DNA, 14 bp, synthetic construct
  source 1..14: mol_type = other DNA
atggaggtatatta

SEQ ID NO: 7708 - DNA, 14 bp, synthetic construct
  source 1..14: mol_type = other DNA
aattgccttataaa

SEQ ID NO: 7709 - DNA, 14 bp, synthetic construct
  source 1..14: mol_type = other DNA
tcatgagactctgt

SEQ ID NO: 7710 - DNA, 14 bp, synthetic construct
  source 1..14: mol_type = other DNA
ttaatgactgggct

SEQ ID NO: 7711 - DNA, 14 bp, synthetic construct
  source 1..14: mol_type = other DNA
attatggcctgcct

SEQ ID NO: 7712 - DNA, 14 bp, synthetic construct
  source 1..14: mol_type = other DNA
ctaacttccatatg

SEQ ID NO: 7713 - DNA, 14 bp, synthetic construct
  source 1..14: mol_type = other DNA
ctgctgtatgaact

SEQ ID NO: 7714 - DNA, 14 bp, synthetic construct
  source 1..14: mol_type = other DNA
tacgtctgcgctgt

SEQ ID NO: 7715 - DNA, 14 bp, synthetic construct
  source 1..14: mol_type = other DNA
cttgagcgtttggc

SEQ ID NO: 7716 - DNA, 14 bp, synthetic construct
  source 1..14: mol_type = other DNA
tagattagtcgtaa

SEQ ID NO: 7717 - DNA, 14 bp, synthetic construct
  source 1..14: mol_type = other DNA
gtcgaatggatctt

SEQ ID NO: 7718 - DNA, 14 bp, synthetic construct
  source 1..14: mol_type = other DNA
gtggcagatttgct

SEQ ID NO: 7719 - DNA, 14 bp, synthetic construct
  source 1..14: mol_type = other DNA
cctcttagaatcat

SEQ ID NO: 7720 - DNA, 14 bp, synthetic construct
  source 1..14: mol_type = other DNA
ttctgtaccgagtc

SEQ ID NO: 7721 - DNA, 14 bp, synthetic construct
  source 1..14: mol_type = other DNA
gtgggtttgaaggt

SEQ ID NO: 7722 - DNA, 14 bp, synthetic construct
  source 1..14: mol_type = other DNA
tcgttacagtctgg

SEQ ID NO: 7723 - DNA, 14 bp, synthetic construct
  source 1..14: mol_type = other DNA
gactgagtgctgtt

SEQ ID NO: 7724 - DNA, 14 bp, synthetic construct
  source 1..14: mol_type = other DNA
tcaatacctatact

SEQ ID NO: 7725 - DNA, 14 bp, synthetic construct
  source 1..14: mol_type = other DNA
tgtttggggaggtc

SEQ ID NO: 7726 - DNA, 14 bp, synthetic construct
  source 1..14: mol_type = other DNA
cactaacgttggtt

SEQ ID NO: 7727 - DNA, 14 bp, synthetic construct
  source 1..14: mol_type = other DNA
tcctacctcatatc

SEQ ID NO: 7728 - DNA, 14 bp, synthetic construct
  source 1..14: mol_type = other DNA
ttggtcggtgcact

SEQ ID NO: 7729 - DNA, 14 bp, synthetic construct
  source 1..14: mol_type = other DNA
tttaggtctggaag

SEQ ID NO: 7730 - DNA, 14 bp, synthetic construct
  source 1..14: mol_type = other DNA
actgtcagttgaat

SEQ ID NO: 7731 - DNA, 14 bp, synthetic construct
  source 1..14: mol_type = other DNA
ggctatcctctaat

SEQ ID NO: 7732 - DNA, 14 bp, synthetic construct
  source 1..14: mol_type = other DNA
caacgttctctgtg

SEQ ID NO: 7733 - DNA, 14 bp, synthetic construct
  source 1..14: mol_type = other DNA
gctggtaacaattt

SEQ ID NO: 7734 - DNA, 14 bp, synthetic construct
  source 1..14: mol_type = other DNA
ttacatatcagcat

SEQ ID NO: 7735 - DNA, 14 bp, synthetic construct
  source 1..14: mol_type = other DNA
caaatttcctatgc

SEQ ID NO: 7736 - DNA, 14 bp, synthetic construct
  source 1..14: mol_type = other DNA
gtatagtttaaccc

SEQ ID NO: 7737 - DNA, 14 bp, synthetic construct
  source 1..14: mol_type = other DNA
aattcccgtgattc

SEQ ID NO: 7738 - DNA, 14 bp, synthetic construct
  source 1..14: mol_type = other DNA
ttgacttagatagc

SEQ ID NO: 7739 - DNA, 14 bp, synthetic construct
  source 1..14: mol_type = other DNA
gactcactttcgtg

SEQ ID NO: 7740 - DNA, 14 bp, synthetic construct
  source 1..14: mol_type = other DNA
ctatgcgactttag

SEQ ID NO: 7741 - DNA, 14 bp, synthetic construct
  source 1..14: mol_type = other DNA
agtagtcgctgtgt

SEQ ID NO: 7742 - DNA, 14 bp, synthetic construct
  source 1..14: mol_type = other DNA
tagtaatgactgtg

SEQ ID NO: 7743 - DNA, 14 bp, synthetic construct
  source 1..14: mol_type = other DNA
acgctctttctcgg

SEQ ID NO: 7744 - DNA, 14 bp, synthetic construct
  source 1..14: mol_type = other DNA
tcggcgtcttggta

SEQ ID NO: 7745 - DNA, 14 bp, synthetic construct
  source 1..14: mol_type = other DNA
tttaggaatcgatc

SEQ ID NO: 7746 - DNA, 14 bp, synthetic construct
  source 1..14: mol_type = other DNA
acgctcattcgttc

SEQ ID NO: 7747 - DNA, 14 bp, synthetic construct
  source 1..14: mol_type = other DNA
ttagttcgataccc

SEQ ID NO: 7748 - DNA, 14 bp, synthetic construct
  source 1..14: mol_type = other DNA
aatcgatgtattac

SEQ ID NO: 7749 - DNA, 14 bp, synthetic construct
  source 1..14: mol_type = other DNA
ttagatacactagt

SEQ ID NO: 7750 - DNA, 14 bp, synthetic construct
  source 1..14: mol_type = other DNA
tactcgggattcta

SEQ ID NO: 7751 - DNA, 14 bp, synthetic construct
  source 1..14: mol_type = other DNA
tcatctgcgtgcat

SEQ ID NO: 7752 - DNA, 14 bp, synthetic construct
  source 1..14: mol_type = other DNA
ctgttagccgttcg

SEQ ID NO: 7753 - DNA, 14 bp, synthetic construct
  source 1..14: mol_type = other DNA
gtatctgttaagac

SEQ ID NO: 7754 - DNA, 14 bp, synthetic construct
  source 1..14: mol_type = other DNA
tactgaaattggct

SEQ ID NO: 7755 - DNA, 14 bp, synthetic construct
  source 1..14: mol_type = other DNA
tttcaccaccatct

SEQ ID NO: 7756 - DNA, 14 bp, synthetic construct
  source 1..14: mol_type = other DNA
acctcggttgcgtt

SEQ ID NO: 7757 - DNA, 14 bp, synthetic construct
  source 1..14: mol_type = other DNA
tccgaagttggtat

SEQ ID NO: 7758 - DNA, 14 bp, synthetic construct
  source 1..14: mol_type = other DNA
taatgccgtgcttg

SEQ ID NO: 7759 - DNA, 14 bp, synthetic construct
  source 1..14: mol_type = other DNA
tcccaccatggttt

SEQ ID NO: 7760 - DNA, 14 bp, synthetic construct
  source 1..14: mol_type = other DNA
atctgcttcacagt

SEQ ID NO: 7761 - DNA, 14 bp, synthetic construct
  source 1..14: mol_type = other DNA
gcttaatgaaattc

SEQ ID NO: 7762 - DNA, 14 bp, synthetic construct
  source 1..14: mol_type = other DNA
ggctatatgttcag

SEQ ID NO: 7763 - DNA, 14 bp, synthetic construct
  source 1..14: mol_type = other DNA
attgtaattgagcc

SEQ ID NO: 7764 - DNA, 14 bp, synthetic construct
  source 1..14: mol_type = other DNA
ttctccgttgccgc

SEQ ID NO: 7765 - DNA, 14 bp, synthetic construct
  source 1..14: mol_type = other DNA
attgtcccgtaggt

SEQ ID NO: 7766 - DNA, 14 bp, synthetic construct
  source 1..14: mol_type = other DNA
atggtacgtttcga

SEQ ID NO: 7767 - DNA, 14 bp, synthetic construct
  source 1..14: mol_type = other DNA
cttggttggctccg

SEQ ID NO: 7768 - DNA, 14 bp, synthetic construct
  source 1..14: mol_type = other DNA
ccgaggtgtgcttt

SEQ ID NO: 7769 - DNA, 14 bp, synthetic construct
  source 1..14: mol_type = other DNA
tactaatccggttc

SEQ ID NO: 7770 - DNA, 14 bp, synthetic construct
  source 1..14: mol_type = other DNA
tgacgtactggtct

SEQ ID NO: 7771 - DNA, 14 bp, synthetic construct
  source 1..14: mol_type = other DNA
tttcgaaccctgat

SEQ ID NO: 7772 - DNA, 14 bp, synthetic construct
  source 1..14: mol_type = other DNA
cttctgcatcatca

SEQ ID NO: 7773 - DNA, 14 bp, synthetic construct
  source 1..14: mol_type = other DNA
gtttttgccagccc

SEQ ID NO: 7774 - DNA, 14 bp, synthetic construct
  source 1..14: mol_type = other DNA
cgagttccttatca

SEQ ID NO: 7775 - DNA, 14 bp, synthetic construct
  source 1..14: mol_type = other DNA
taagaattttgcga

SEQ ID NO: 7776 - DNA, 14 bp, synthetic construct
  source 1..14: mol_type = other DNA
caatatattgagtg

SEQ ID NO: 7777 - DNA, 14 bp, synthetic construct
  source 1..14: mol_type = other DNA
attgattcggactg

SEQ ID NO: 7778 - DNA, 14 bp, synthetic construct
  source 1..14: mol_type = other DNA
accactagatttct

SEQ ID NO: 7779 - DNA, 14 bp, synthetic construct
  source 1..14: mol_type = other DNA
actttacaaactct

SEQ ID NO: 7780 - DNA, 14 bp, synthetic construct
  source 1..14: mol_type = other DNA
acttgacatgatgt

SEQ ID NO: 7781 - DNA, 14 bp, synthetic construct
  source 1..14: mol_type = other DNA
gtgatctttgccgg

SEQ ID NO: 7782 - DNA, 14 bp, synthetic construct
  source 1..14: mol_type = other DNA
tgcgcgtttggaat

SEQ ID NO: 7783 - DNA, 14 bp, synthetic construct
  source 1..14: mol_type = other DNA
agtgcctagtgtat

SEQ ID NO: 7784 - DNA, 14 bp, synthetic construct
  source 1..14: mol_type = other DNA
tccttctcatgacg

SEQ ID NO: 7785 - DNA, 14 bp, synthetic construct
  source 1..14: mol_type = other DNA
ccttacctcttccg

SEQ ID NO: 7786 - DNA, 14 bp, synthetic construct
  source 1..14: mol_type = other DNA
gctgtcctgtgtaa

SEQ ID NO: 7787 - DNA, 14 bp, synthetic construct
  source 1..14: mol_type = other DNA
gatctcgtatggat

SEQ ID NO: 7788 - DNA, 14 bp, synthetic construct
  source 1..14: mol_type = other DNA
tggtttgtacgcag

SEQ ID NO: 7789 - DNA, 14 bp, synthetic construct
  source 1..14: mol_type = other DNA
attggtcgtccatg

SEQ ID NO: 7790 - DNA, 14 bp, synthetic construct
  source 1..14: mol_type = other DNA
tatacattcctacc

SEQ ID NO: 7791 - DNA, 14 bp, synthetic construct
  source 1..14: mol_type = other DNA
attcggttcgtgca

SEQ ID NO: 7792 - DNA, 14 bp, synthetic construct
  source 1..14: mol_type = other DNA
tgagctgtggtatc

SEQ ID NO: 7793 - DNA, 14 bp, synthetic construct
  source 1..14: mol_type = other DNA
acagtttagccctt

SEQ ID NO: 7794 - DNA, 14 bp, synthetic construct
  source 1..14: mol_type = other DNA
caattgtacatcct

SEQ ID NO: 7795 - DNA, 14 bp, synthetic construct
  source 1..14: mol_type = other DNA
ataacggctctgtt

SEQ ID NO: 7796 - DNA, 14 bp, synthetic construct
  source 1..14: mol_type = other DNA
ctttcctacgtcag

SEQ ID NO: 7797 - DNA, 14 bp, synthetic construct
  source 1..14: mol_type = other DNA
tctagtcctgtaca

SEQ ID NO: 7798 - DNA, 14 bp, synthetic construct
  source 1..14: mol_type = other DNA
ttgcgggtgcgtta

SEQ ID NO: 7799 - DNA, 14 bp, synthetic construct
  source 1..14: mol_type = other DNA
agtttgactctagc

SEQ ID NO: 7800 - DNA, 14 bp, synthetic construct
  source 1..14: mol_type = other DNA
ttacatcaatccct

SEQ ID NO: 7801 - DNA, 14 bp, synthetic construct
  source 1..14: mol_type = other DNA
cggttagattgtag

SEQ ID NO: 7802 - DNA, 14 bp, synthetic construct
  source 1..14: mol_type = other DNA
gggtagcttcatta

SEQ ID NO: 7803 - DNA, 14 bp, synthetic construct
  source 1..14: mol_type = other DNA
ggatacgtatttgc

SEQ ID NO: 7804 - DNA, 14 bp, synthetic construct
  source 1..14: mol_type = other DNA
ccattggcgtctat

SEQ ID NO: 7805 - DNA, 14 bp, synthetic construct
  source 1..14: mol_type = other DNA
ccgattgagtcttg

SEQ ID NO: 7806 - DNA, 14 bp, synthetic construct
  source 1..14: mol_type = other DNA
ttggagtagatcta

SEQ ID NO: 7807 - DNA, 14 bp, synthetic construct
  source 1..14: mol_type = other DNA
atttggacttacgc

SEQ ID NO: 7808 - DNA, 14 bp, synthetic construct
  source 1..14: mol_type = other DNA
tgtcttagatagcc

SEQ ID NO: 7809 - DNA, 14 bp, synthetic construct
  source 1..14: mol_type = other DNA
ttctgactacaggt

SEQ ID NO: 7810 - DNA, 14 bp, synthetic construct
  source 1..14: mol_type = other DNA
caattcatgacttc

SEQ ID NO: 7811 - DNA, 14 bp, synthetic construct
  source 1..14: mol_type = other DNA
cactttggtaactg

SEQ ID NO: 7812 - DNA, 14 bp, synthetic construct
  source 1..14: mol_type = other DNA
ttatagctgagact

SEQ ID NO: 7813 - DNA, 14 bp, synthetic construct
  source 1..14: mol_type = other DNA
aaggatctttgctg

SEQ ID NO: 7814 - DNA, 14 bp, synthetic construct
  source 1..14: mol_type = other DNA
gttttgacatacag

SEQ ID NO: 7815 - DNA, 14 bp, synthetic construct
  source 1..14: mol_type = other DNA
tactgttgtgagcg

SEQ ID NO: 7816 - DNA, 14 bp, synthetic construct
  source 1..14: mol_type = other DNA
tcaggttctactgg

SEQ ID NO: 7817 - DNA, 14 bp, synthetic construct
  source 1..14: mol_type = other DNA
tactgtgcgggttg

SEQ ID NO: 7818 - DNA, 14 bp, synthetic construct
  source 1..14: mol_type = other DNA
cagcgtttttgccc

SEQ ID NO: 7819 - DNA, 14 bp, synthetic construct
  source 1..14: mol_type = other DNA
ctcttctcaaataa

SEQ ID NO: 7820 - DNA, 14 bp, synthetic construct
  source 1..14: mol_type = other DNA
cgtgctgagtttca

SEQ ID NO: 7821 - DNA, 14 bp, synthetic construct
  source 1..14: mol_type = other DNA
tcctttcccgtaag

SEQ ID NO: 7822 - DNA, 14 bp, synthetic construct
  source 1..14: mol_type = other DNA
gtatggtgattcgg

SEQ ID NO: 7823 - DNA, 14 bp, synthetic construct
  source 1..14: mol_type = other DNA
gtaacgttttaagc

SEQ ID NO: 7824 - DNA, 14 bp, synthetic construct
  source 1..14: mol_type = other DNA
gagtttagatatca

SEQ ID NO: 7825 - DNA, 14 bp, synthetic construct
  source 1..14: mol_type = other DNA
gaatttttggcaag

SEQ ID NO: 7826 - DNA, 14 bp, synthetic construct
  source 1..14: mol_type = other DNA
ttggaagttcgtgg

SEQ ID NO: 7827 - DNA, 14 bp, synthetic construct
  source 1..14: mol_type = other DNA
tgagtcacttaaat

SEQ ID NO: 7828 - DNA, 14 bp, synthetic construct
  source 1..14: mol_type = other DNA
tcagccgttcctgt

SEQ ID NO: 7829 - DNA, 14 bp, synthetic construct
  source 1..14: mol_type = other DNA
ctcgagtacttggt

SEQ ID NO: 7830 - DNA, 14 bp, synthetic construct
  source 1..14: mol_type = other DNA
tcatgtagtcagtc

SEQ ID NO: 7831 - DNA, 14 bp, synthetic construct
  source 1..14: mol_type = other DNA
cttacggttaatgg

SEQ ID NO: 7832 - DNA, 14 bp, synthetic construct
  source 1..14: mol_type = other DNA
cgttgattacgtac

SEQ ID NO: 7833 - DNA, 14 bp, synthetic construct
  source 1..14: mol_type = other DNA
gtcaggcctagttt

SEQ ID NO: 7834 - DNA, 14 bp, synthetic construct
  source 1..14: mol_type = other DNA
aagcgcttaggttt

SEQ ID NO: 7835 - DNA, 14 bp, synthetic construct
  source 1..14: mol_type = other DNA
tggctgaatgttgg

SEQ ID NO: 7836 - DNA, 14 bp, synthetic construct
  source 1..14: mol_type = other DNA
cggtaattggattc

SEQ ID NO: 7837 - DNA, 14 bp, synthetic construct
  source 1..14: mol_type = other DNA
gtaccaattttacc

SEQ ID NO: 7838 - DNA, 14 bp, synthetic construct
  source 1..14: mol_type = other DNA
ctgtggatctcaat

SEQ ID NO: 7839 - DNA, 14 bp, synthetic construct
  source 1..14: mol_type = other DNA
acatttgcctcgtg

SEQ ID NO: 7840 - DNA, 14 bp, synthetic construct
  source 1..14: mol_type = other DNA
agactctgttgcta

SEQ ID NO: 7841 - DNA, 14 bp, synthetic construct
  source 1..14: mol_type = other DNA
gtgttagcttacca

SEQ ID NO: 7842 - DNA, 14 bp, synthetic construct
  source 1..14: mol_type = other DNA
tatttgccatgcga

SEQ ID NO: 7843 - DNA, 14 bp, synthetic construct
  source 1..14: mol_type = other DNA
gcttcattaggtgc

SEQ ID NO: 7844 - DNA, 14 bp, synthetic construct
  source 1..14: mol_type = other DNA
tagatcagggttta

SEQ ID NO: 7845 - DNA, 14 bp, synthetic construct
  source 1..14: mol_type = other DNA
agatttaactgtcc

SEQ ID NO: 7846 - DNA, 14 bp, synthetic construct
  source 1..14: mol_type = other DNA
cgatctgttggatg

SEQ ID NO: 7847 - DNA, 14 bp, synthetic construct
  source 1..14: mol_type = other DNA
taaatggccctatt

SEQ ID NO: 7848 - DNA, 14 bp, synthetic construct
  source 1..14: mol_type = other DNA
ttatctcggcactg

SEQ ID NO: 7849 - DNA, 14 bp, synthetic construct
  source 1..14: mol_type = other DNA
caatcctatgattg

SEQ ID NO: 7850 - DNA, 14 bp, synthetic construct
  source 1..14: mol_type = other DNA
atcaagatagtttg

SEQ ID NO: 7851 - DNA, 14 bp, synthetic construct
  source 1..14: mol_type = other DNA
atttgattcgaaaa

SEQ ID NO: 7852 - DNA, 14 bp, synthetic construct
  source 1..14: mol_type = other DNA
cgaggttgtcttca

SEQ ID NO: 7853 - DNA, 14 bp, synthetic construct
  source 1..14: mol_type = other DNA
tatcaggatcgatt

SEQ ID NO: 7854 - DNA, 14 bp, synthetic construct
  source 1..14: mol_type = other DNA
tctagatggcatgt

SEQ ID NO: 7855 - DNA, 14 bp, synthetic construct
  source 1..14: mol_type = other DNA
taaaatgggttctg

SEQ ID NO: 7856 - DNA, 14 bp, synthetic construct
  source 1..14: mol_type = other DNA
gagattgaatgtct

SEQ ID NO: 7857 - DNA, 14 bp, synthetic construct
  source 1..14: mol_type = other DNA
tgctgattctcacg

SEQ ID NO: 7858 - DNA, 14 bp, synthetic construct
  source 1..14: mol_type = other DNA
ggatccatattgat

SEQ ID NO: 7859 - DNA, 14 bp, synthetic construct
  source 1..14: mol_type = other DNA
ttgtactcgctagc

SEQ ID NO: 7860 - DNA, 14 bp, synthetic construct
  source 1..14: mol_type = other DNA
tcattccctgtccg

SEQ ID NO: 7861 - DNA, 14 bp, synthetic construct
  source 1..14: mol_type = other DNA
ttcagggcttggtg

SEQ ID NO: 7862 - DNA, 14 bp, synthetic construct
  source 1..14: mol_type = other DNA
ctgattcatgcgct

SEQ ID NO: 7863 - DNA, 14 bp, synthetic construct
  source 1..14: mol_type = other DNA
gacgctattggctt

SEQ ID NO: 7864 - DNA, 14 bp, synthetic construct
  source 1..14: mol_type = other DNA
gtgcttatcgtacc

SEQ ID NO: 7865 - DNA, 14 bp, synthetic construct
  source 1..14: mol_type = other DNA
ataatgtatggatg

SEQ ID NO: 7866 - DNA, 14 bp, synthetic construct
  source 1..14: mol_type = other DNA
cactctaagtttaa

SEQ ID NO: 7867 - DNA, 14 bp, synthetic construct
  source 1..14: mol_type = other DNA
caatttagtatcac

SEQ ID NO: 7868 - DNA, 14 bp, synthetic construct
  source 1..14: mol_type = other DNA
gtcttcgtagccta

SEQ ID NO: 7869 - DNA, 14 bp, synthetic construct
  source 1..14: mol_type = other DNA
cacattgtcttaag

SEQ ID NO: 7870 - DNA, 14 bp, synthetic construct
  source 1..14: mol_type = other DNA
caattatcgtctta

SEQ ID NO: 7871 - DNA, 14 bp, synthetic construct
  source 1..14: mol_type = other DNA
cttaagtctcttcc

SEQ ID NO: 7872 - DNA, 14 bp, synthetic construct
  source 1..14: mol_type = other DNA
attctaccgattgt

SEQ ID NO: 7873 - DNA, 14 bp, synthetic construct
  source 1..14: mol_type = other DNA
tagttgcttctcag

SEQ ID NO: 7874 - DNA, 14 bp, synthetic construct
  source 1..14: mol_type = other DNA
tatctccctcttca

SEQ ID NO: 7875 - DNA, 14 bp, synthetic construct
  source 1..14: mol_type = other DNA
tttcctctagacat

SEQ ID NO: 7876 - DNA, 14 bp, synthetic construct
  source 1..14: mol_type = other DNA
ttatgctatcgtcg

SEQ ID NO: 7877 - DNA, 14 bp, synthetic construct
  source 1..14: mol_type = other DNA
ccgtatttccgtat

SEQ ID NO: 7878 - DNA, 14 bp, synthetic construct
  source 1..14: mol_type = other DNA
ggatttttcctcag

SEQ ID NO: 7879 - DNA, 14 bp, synthetic construct
  source 1..14: mol_type = other DNA
gttggtcgatctct

SEQ ID NO: 7880 - DNA, 14 bp, synthetic construct
  source 1..14: mol_type = other DNA
tctctccgtcctgt

SEQ ID NO: 7881 - DNA, 14 bp, synthetic construct
  source 1..14: mol_type = other DNA
attcagcctttaat

SEQ ID NO: 7882 - DNA, 14 bp, synthetic construct
  source 1..14: mol_type = other DNA
ctcattattctggc

SEQ ID NO: 7883 - DNA, 14 bp, synthetic construct
  source 1..14: mol_type = other DNA
atacttctcacgtt

SEQ ID NO: 7884 - DNA, 14 bp, synthetic construct
  source 1..14: mol_type = other DNA
tttgctacgtcact

SEQ ID NO: 7885 - DNA, 14 bp, synthetic construct
  source 1..14: mol_type = other DNA
ctttctctgactcg

SEQ ID NO: 7886 - DNA, 14 bp, synthetic construct
  source 1..14: mol_type = other DNA
gttttatacggtaa

SEQ ID NO: 7887 - DNA, 14 bp, synthetic construct
  source 1..14: mol_type = other DNA
gttagatgtgttga

SEQ ID NO: 7888 - DNA, 14 bp, synthetic construct
  source 1..14: mol_type = other DNA
tgagtgatttagtg

SEQ ID NO: 7889 - DNA, 14 bp, synthetic construct
  source 1..14: mol_type = other DNA
tttactgaacttgc

SEQ ID NO: 7890 - DNA, 14 bp, synthetic construct
  source 1..14: mol_type = other DNA
taatggttgcttga

SEQ ID NO: 7891 - DNA, 14 bp, synthetic construct
  source 1..14: mol_type = other DNA
tcggtattggcttc

SEQ ID NO: 7892 - DNA, 14 bp, synthetic construct
  source 1..14: mol_type = other DNA
tgcattaatactct

SEQ ID NO: 7893 - DNA, 14 bp, synthetic construct
  source 1..14: mol_type = other DNA
ttctatctgtcgga

SEQ ID NO: 7894 - DNA, 14 bp, synthetic construct
  source 1..14: mol_type = other DNA
ggtattatgggtct

SEQ ID NO: 7895 - DNA, 14 bp, synthetic construct
  source 1..14: mol_type = other DNA
ctttcgtgtctcaa

SEQ ID NO: 7896 - DNA, 14 bp, synthetic construct
  source 1..14: mol_type = other DNA
ttgctccgttggta

SEQ ID NO: 7897 - DNA, 14 bp, synthetic construct
  source 1..14: mol_type = other DNA
gatgatgttaggtt

SEQ ID NO: 7898 - DNA, 14 bp, synthetic construct
  source 1..14: mol_type = other DNA
cttcatgcgccttt

SEQ ID NO: 7899 - DNA, 14 bp, synthetic construct
  source 1..14: mol_type = other DNA
ctgtattccttgcc

SEQ ID NO: 7900 - DNA, 14 bp, synthetic construct
  source 1..14: mol_type = other DNA
tgtagtaaatcatt

SEQ ID NO: 7901 - DNA, 14 bp, synthetic construct
  source 1..14: mol_type = other DNA
actgggttatctct

SEQ ID NO: 7902 - DNA, 14 bp, synthetic construct
  source 1..14: mol_type = other DNA
gtccgctggtttta

SEQ ID NO: 7903 - DNA, 14 bp, synthetic construct
  source 1..14: mol_type = other DNA
atgatttgctacat

SEQ ID NO: 7904 - DNA, 14 bp, synthetic construct
  source 1..14: mol_type = other DNA
tcttccccttagat

SEQ ID NO: 7905 - DNA, 14 bp, synthetic construct
  source 1..14: mol_type = other DNA
tattcgtctgcgat

SEQ ID NO: 7906 - DNA, 14 bp, synthetic construct
  source 1..14: mol_type = other DNA
ttcggtattccact

SEQ ID NO: 7907 - DNA, 14 bp, synthetic construct
  source 1..14: mol_type = other DNA
ctaggttttacaat

SEQ ID NO: 7908 - DNA, 14 bp, synthetic construct
  source 1..14: mol_type = other DNA
agatttcgttcatc

SEQ ID NO: 7909 - DNA, 14 bp, synthetic construct
  source 1..14: mol_type = other DNA
cctcatgtttgatg

SEQ ID NO: 7910 - DNA, 14 bp, synthetic construct
  source 1..14: mol_type = other DNA
catggtttgtaact

SEQ ID NO: 7911 - DNA, 14 bp, synthetic construct
  source 1..14: mol_type = other DNA
gctactttactctg

SEQ ID NO: 7912 - DNA, 14 bp, synthetic construct
  source 1..14: mol_type = other DNA
tgcacttccctatt

SEQ ID NO: 7913 - DNA, 14 bp, synthetic construct
  source 1..14: mol_type = other DNA
accttatcatgctt

SEQ ID NO: 7914 - DNA, 14 bp, synthetic construct
  source 1..14: mol_type = other DNA
tgttctattgggca

SEQ ID NO: 7915 - DNA, 14 bp, synthetic construct
  source 1..14: mol_type = other DNA
acgcttactttgtg

SEQ ID NO: 7916 - DNA, 14 bp, synthetic construct
  source 1..14: mol_type = other DNA
ggtgctgtcgttta

SEQ ID NO: 7917 - DNA, 14 bp, synthetic construct
  source 1..14: mol_type = other DNA
cactttatagttca

SEQ ID NO: 7918 - DNA, 14 bp, synthetic construct
  source 1..14: mol_type = other DNA
tgctttttggaaga

SEQ ID NO: 7919 - DNA, 14 bp, synthetic construct
  source 1..14: mol_type = other DNA
attgcctgcttctg

SEQ ID NO: 7920 - DNA, 14 bp, synthetic construct
  source 1..14: mol_type = other DNA
aggagttcgttatt

SEQ ID NO: 7921 - DNA, 14 bp, synthetic construct
  source 1..14: mol_type = other DNA
atactttttccaag

SEQ ID NO: 7922 - DNA, 14 bp, synthetic construct
  source 1..14: mol_type = other DNA
tcgattgtgttagc

SEQ ID NO: 7923 - DNA, 14 bp, synthetic construct
  source 1..14: mol_type = other DNA
tctctggcggtttg

SEQ ID NO: 7924 - DNA, 14 bp, synthetic construct
  source 1..14: mol_type = other DNA
cttcgcattcttga

SEQ ID NO: 7925 - DNA, 14 bp, synthetic construct
  source 1..14: mol_type = other DNA
gtcgtttcttcaac

SEQ ID NO: 7926 - DNA, 14 bp, synthetic construct
  source 1..14: mol_type = other DNA
ttccattattcacg

SEQ ID NO: 7927 - DNA, 14 bp, synthetic construct
  source 1..14: mol_type = other DNA
aatgtcgtctatat

SEQ ID NO: 7928 - DNA, 14 bp, synthetic construct
  source 1..14: mol_type = other DNA
atttggtatggggt

SEQ ID NO: 7929 - DNA, 14 bp, synthetic construct
  source 1..14: mol_type = other DNA
gtcaagttgttcgt

SEQ ID NO: 7930 - DNA, 14 bp, synthetic construct
  source 1..14: mol_type = other DNA
tcgactttatacat

SEQ ID NO: 7931 - DNA, 14 bp, synthetic construct
  source 1..14: mol_type = other DNA
tgtctgttccgatc

SEQ ID NO: 7932 - DNA, 14 bp, synthetic construct
  source 1..14: mol_type = other DNA
tatacatgtgtctg

SEQ ID NO: 7933 - DNA, 14 bp, synthetic construct
  source 1..14: mol_type = other DNA
gtgtgctaacttct

SEQ ID NO: 7934 - DNA, 14 bp, synthetic construct
  source 1..14: mol_type = other DNA
gtccatatgctttg

SEQ ID NO: 7935 - DNA, 14 bp, synthetic construct
  source 1..14: mol_type = other DNA
tacattgcttgtag

SEQ ID NO: 7936 - DNA, 14 bp, synthetic construct
  source 1..14: mol_type = other DNA
cccttcctttcatg

SEQ ID NO: 7937 - DNA, 14 bp, synthetic construct
  source 1..14: mol_type = other DNA
acatttgtacagtt

SEQ ID NO: 7938 - DNA, 14 bp, synthetic construct
  source 1..14: mol_type = other DNA
gcttgttataacct

SEQ ID NO: 7939 - DNA, 14 bp, synthetic construct
  source 1..14: mol_type = other DNA
ttggtatggatgtg

SEQ ID NO: 7940 - DNA, 14 bp, synthetic construct
  source 1..14: mol_type = other DNA
aatgatttagtgta

SEQ ID NO: 7941 - DNA, 14 bp, synthetic construct
  source 1..14: mol_type = other DNA
ttttcgtaaacatg

SEQ ID NO: 7942 - DNA, 14 bp, synthetic construct
  source 1..14: mol_type = other DNA
atgaattagcttct

SEQ ID NO: 7943 - DNA, 14 bp, synthetic construct
  source 1..14: mol_type = other DNA
ctacatttggtgct

SEQ ID NO: 7944 - DNA, 14 bp, synthetic construct
  source 1..14: mol_type = other DNA
attgtggtgaattc

SEQ ID NO: 7945 - DNA, 14 bp, synthetic construct
  source 1..14: mol_type = other DNA
tctatgaattagct

SEQ ID NO: 7946 - DNA, 14 bp, synthetic construct
  source 1..14: mol_type = other DNA
ttactttccatcgc

SEQ ID NO: 7947 - DNA, 14 bp, synthetic construct
  source 1..14: mol_type = other DNA
atctgttgcgtctc

SEQ ID NO: 7948 - DNA, 14 bp, synthetic construct
  source 1..14: mol_type = other DNA
agctcgtgtgttat

SEQ ID NO: 7949 - DNA, 14 bp, synthetic construct
  source 1..14: mol_type = other DNA
tttcgacgattatg

SEQ ID NO: 7950 - DNA, 14 bp, synthetic construct
  source 1..14: mol_type = other DNA
taaggttgctttgg

SEQ ID NO: 7951 - DNA, 14 bp, synthetic construct
  source 1..14: mol_type = other DNA
cgcgtgttgcttgt

SEQ ID NO: 7952 - DNA, 14 bp, synthetic construct
  source 1..14: mol_type = other DNA
catatagttggtat

SEQ ID NO: 7953 - DNA, 14 bp, synthetic construct
  source 1..14: mol_type = other DNA
tttctcacctataa

SEQ ID NO: 7954 - DNA, 14 bp, synthetic construct
  source 1..14: mol_type = other DNA
tgtacttttaacgc

SEQ ID NO: 7955 - DNA, 14 bp, synthetic construct
  source 1..14: mol_type = other DNA
ttggtcactttccg

SEQ ID NO: 7956 - DNA, 14 bp, synthetic construct
  source 1..14: mol_type = other DNA
ttatggctcttccg

SEQ ID NO: 7957 - DNA, 14 bp, synthetic construct
  source 1..14: mol_type = other DNA
tgctgatttatagc

SEQ ID NO: 7958 - DNA, 14 bp, synthetic construct
  source 1..14: mol_type = other DNA
tggattttacagtc

SEQ ID NO: 7959 - DNA, 14 bp, synthetic construct
  source 1..14: mol_type = other DNA
ttctcgtcagttgg

SEQ ID NO: 7960 - DNA, 14 bp, synthetic construct
  source 1..14: mol_type = other DNA
tagatcgtttgtgc

SEQ ID NO: 7961 - DNA, 14 bp, synthetic construct
  source 1..14: mol_type = other DNA
ttgcactttaaatc

SEQ ID NO: 7962 - DNA, 14 bp, synthetic construct
  source 1..14: mol_type = other DNA
ctttacctgtataa

SEQ ID NO: 7963 - DNA, 14 bp, synthetic construct
  source 1..14: mol_type = other DNA
tacaacgttcgttt

SEQ ID NO: 7964 - DNA, 14 bp, synthetic construct
  source 1..14: mol_type = other DNA
cgttatatactcat

SEQ ID NO: 7965 - DNA, 14 bp, synthetic construct
  source 1..14: mol_type = other DNA
tcctttattgacgg

SEQ ID NO: 7966 - DNA, 14 bp, synthetic construct
  source 1..14: mol_type = other DNA
tgtgggttcttcaa

SEQ ID NO: 7967 - DNA, 14 bp, synthetic construct
  source 1..14: mol_type = other DNA
tgcctcgtcattct

SEQ ID NO: 7968 - DNA, 14 bp, synthetic construct
  source 1..14: mol_type = other DNA
tgttacgtttcaga

SEQ ID NO: 7969 - DNA, 14 bp, synthetic construct
  source 1..14: mol_type = other DNA
atctcatacttgtc

SEQ ID NO: 7970 - DNA, 14 bp, synthetic construct
  source 1..14: mol_type = other DNA
tgttagttcgtccg

SEQ ID NO: 7971 - DNA, 14 bp, synthetic construct
  source 1..14: mol_type = other DNA
tacctttatagtcg

SEQ ID NO: 7972 - DNA, 14 bp, synthetic construct
  source 1..14: mol_type = other DNA
atctggataattct

SEQ ID NO: 7973 - DNA, 14 bp, synthetic construct
  source 1..14: mol_type = other DNA
ctatcgttttgcca

SEQ ID NO: 7974 - DNA, 14 bp, synthetic construct
  source 1..14: mol_type = other DNA
aacctttttggctg

SEQ ID NO: 7975 - DNA, 14 bp, synthetic construct
  source 1..14: mol_type = other DNA
atctacatgtctct

SEQ ID NO: 7976 - DNA, 14 bp, synthetic construct
  source 1..14: mol_type = other DNA
catctttgacatct

SEQ ID NO: 7977 - DNA, 14 bp, synthetic construct
  source 1..14: mol_type = other DNA
gtacttcctaactt

SEQ ID NO: 7978 - DNA, 14 bp, synthetic construct
  source 1..14: mol_type = other DNA
ctatatcaattcta

SEQ ID NO: 7979 - DNA, 14 bp, synthetic construct
  source 1..14: mol_type = other DNA
ttagatgtttcaca

SEQ ID NO: 7980 - DNA, 14 bp, synthetic construct
  source 1..14: mol_type = other DNA
tagcattgtcgttc

SEQ ID NO: 7981 - DNA, 14 bp, synthetic construct
  source 1..14: mol_type = other DNA
ccttgtctgctcgt

SEQ ID NO: 7982 - DNA, 14 bp, synthetic construct
  source 1..14: mol_type = other DNA
ttagccgttgattc

SEQ ID NO: 7983 - DNA, 14 bp, synthetic construct
  source 1..14: mol_type = other DNA
aacttactaatgtt

SEQ ID NO: 7984 - DNA, 14 bp, synthetic construct
  source 1..14: mol_type = other DNA
agactttctttaca

SEQ ID NO: 7985 - DNA, 14 bp, synthetic construct
  source 1..14: mol_type = other DNA
agttctaagtctct

SEQ ID NO: 7986 - DNA, 14 bp, synthetic construct
  source 1..14: mol_type = other DNA
tggttttatagcga

SEQ ID NO: 7987 - DNA, 14 bp, synthetic construct
  source 1..14: mol_type = other DNA
cacttcgttcctta

SEQ ID NO: 7988 - DNA, 14 bp, synthetic construct
  source 1..14: mol_type = other DNA
tcatcagttacatt

SEQ ID NO: 7989 - DNA, 14 bp, synthetic construct
  source 1..14: mol_type = other DNA
tgcgtttgtaatag

SEQ ID NO: 7990 - DNA, 14 bp, synthetic construct
  source 1..14: mol_type = other DNA
ggatattaattcat

SEQ ID NO: 7991 - DNA, 14 bp, synthetic construct
  source 1..14: mol_type = other DNA
gagtctcctgtgtt

SEQ ID NO: 7992 - DNA, 14 bp, synthetic construct
  source 1..14: mol_type = other DNA
aatgtatggccttt

SEQ ID NO: 7993 - DNA, 14 bp, synthetic construct
  source 1..14: mol_type = other DNA
tgccaagtgctttt

SEQ ID NO: 7994 - DNA, 14 bp, synthetic construct
  source 1..14: mol_type = other DNA
actcctttgttccg

SEQ ID NO: 7995 - DNA, 14 bp, synthetic construct
  source 1..14: mol_type = other DNA
gagtactttgatat

SEQ ID NO: 7996 - DNA, 14 bp, synthetic construct
  source 1..14: mol_type = other DNA
catctttctgtcga

SEQ ID NO: 7997 - DNA, 14 bp, synthetic construct
  source 1..14: mol_type = other DNA
tggttgcggttata

SEQ ID NO: 7998 - DNA, 14 bp, synthetic construct
  source 1..14: mol_type = other DNA
tttacttaacggat

SEQ ID NO: 7999 - DNA, 14 bp, synthetic construct
  source 1..14: mol_type = other DNA
ttttgggcgaaatt

SEQ ID NO: 8000 - DNA, 14 bp, synthetic construct
  source 1..14: mol_type = other DNA
tacagttcatatgt

SEQ ID NO: 8001 - DNA, 14 bp, synthetic construct
  source 1..14: mol_type = other DNA
gtatagccttgatt

SEQ ID NO: 8002 - DNA, 14 bp, synthetic construct
  source 1..14: mol_type = other DNA
ctttgagcggtctt

SEQ ID NO: 8003 - DNA, 14 bp, synthetic construct
  source 1..14: mol_type = other DNA
atttgcttaactac

SEQ ID NO: 8004 - DNA, 14 bp, synthetic construct
  source 1..14: mol_type = other DNA
tttcgctttccacc

SEQ ID NO: 8005 - DNA, 14 bp, synthetic construct
  source 1..14: mol_type = other DNA
aagtatcttgtagt

SEQ ID NO: 8006 - DNA, 14 bp, synthetic construct
  source 1..14: mol_type = other DNA
acagtgctttttca

SEQ ID NO: 8007 - DNA, 14 bp, synthetic construct
  source 1..14: mol_type = other DNA
gttaccagatgttt

SEQ ID NO: 8008 - DNA, 14 bp, synthetic construct
  source 1..14: mol_type = other DNA
gtttgcttcaaatg

SEQ ID NO: 8009 - DNA, 14 bp, synthetic construct
  source 1..14: mol_type = other DNA
ttttgcttaccgga

SEQ ID NO: 8010 - DNA, 14 bp, synthetic construct
  source 1..14: mol_type = other DNA
taattcatcatcat

SEQ ID NO: 8011 - DNA, 14 bp, synthetic construct
  source 1..14: mol_type = other DNA
ctgttctgccttca

SEQ ID NO: 8012 - DNA, 14 bp, synthetic construct
  source 1..14: mol_type = other DNA
gggttaatttatgg

SEQ ID NO: 8013 - DNA, 14 bp, synthetic construct
  source 1..14: mol_type = other DNA
attgaattctggta

SEQ ID NO: 8014 - DNA, 14 bp, synthetic construct
  source 1..14: mol_type = other DNA
tttcgctactcata

SEQ ID NO: 8015 - DNA, 14 bp, synthetic construct
  source 1..14: mol_type = other DNA
tggttttatgagcc

SEQ ID NO: 8016 - DNA, 14 bp, synthetic construct
  source 1..14: mol_type = other DNA
gtattatcaatcat

SEQ ID NO: 8017 - DNA, 14 bp, synthetic construct
  source 1..14: mol_type = other DNA
ttctccactctagt

SEQ ID NO: 8018 - DNA, 14 bp, synthetic construct
  source 1..14: mol_type = other DNA
gtcattgagtttac

SEQ ID NO: 8019 - DNA, 14 bp, synthetic construct
  source 1..14: mol_type = other DNA
tctgtttgcaagta

SEQ ID NO: 8020 - DNA, 14 bp, synthetic construct
  source 1..14: mol_type = other DNA
gctttttcgctgaa

SEQ ID NO: 8021 - DNA, 14 bp, synthetic construct
  source 1..14: mol_type = other DNA
agctttgttgagtc

SEQ ID NO: 8022 - DNA, 14 bp, synthetic construct
  source 1..14: mol_type = other DNA
gtattttaacctgg

SEQ ID NO: 8023 - DNA, 14 bp, synthetic construct
  source 1..14: mol_type = other DNA
ctagtttagttcgg

SEQ ID NO: 8024 - DNA, 14 bp, synthetic construct
  source 1..14: mol_type = other DNA
tggcttctgttaag

SEQ ID NO: 8025 - DNA, 14 bp, synthetic construct
  source 1..14: mol_type = other DNA
gtgatgtccttact

SEQ ID NO: 8026 - DNA, 14 bp, synthetic construct
  source 1..14: mol_type = other DNA
ttttgatccgaggt

SEQ ID NO: 8027 - DNA, 14 bp, synthetic construct
  source 1..14: mol_type = other DNA
tgagtttacgttct

SEQ ID NO: 8028 - DNA, 14 bp, synthetic construct
  source 1..14: mol_type = other DNA
gcttttattgaatc

SEQ ID NO: 8029 - DNA, 14 bp, synthetic construct
  source 1..14: mol_type = other DNA
ctaattttagtcta

SEQ ID NO: 8030 - DNA, 14 bp, synthetic construct
  source 1..14: mol_type = other DNA
ataatgtcgttttg

SEQ ID NO: 8031 - DNA, 14 bp, synthetic construct
  source 1..14: mol_type = other DNA
tctaattccgttgt

SEQ ID NO: 8032 - DNA, 14 bp, synthetic construct
  source 1..14: mol_type = other DNA
ttacgttttgtggc

SEQ ID NO: 8033 - DNA, 14 bp, synthetic construct
  source 1..14: mol_type = other DNA
aggtttttgctgat

SEQ ID NO: 8034 - DNA, 14 bp, synthetic construct
  source 1..14: mol_type = other DNA
tggctttgtctcat

SEQ ID NO: 8035 - DNA, 14 bp, synthetic construct
  source 1..14: mol_type = other DNA
cttccccgtttttc

SEQ ID NO: 8036 - DNA, 14 bp, synthetic construct
  source 1..14: mol_type = other DNA
gttgctttttccca

SEQ ID NO: 8037 - DNA, 14 bp, synthetic construct
  source 1..14: mol_type = other DNA
ccctattgtgtgtt

SEQ ID NO: 8038 - DNA, 14 bp, synthetic construct
  source 1..14: mol_type = other DNA
catgttcgtgtatt

SEQ ID NO: 8039 - DNA, 14 bp, synthetic construct
  source 1..14: mol_type = other DNA
ctactctttaatta

SEQ ID NO: 8040 - DNA, 14 bp, synthetic construct
  source 1..14: mol_type = other DNA
cattgtatcattta

SEQ ID NO: 8041 - DNA, 14 bp, synthetic construct
  source 1..14: mol_type = other DNA
cgtgttctgtggtt

SEQ ID NO: 8042 - DNA, 14 bp, synthetic construct
  source 1..14: mol_type = other DNA
tctactgttaatat

SEQ ID NO: 8043 - DNA, 14 bp, synthetic construct
  source 1..14: mol_type = other DNA
ttgtgcgatttatg

SEQ ID NO: 8044 - DNA, 14 bp, synthetic construct
  source 1..14: mol_type = other DNA
tttctatcgttaaa

SEQ ID NO: 8045 - DNA, 14 bp, synthetic construct
  source 1..14: mol_type = other DNA
tttgtcctcggttc

SEQ ID NO: 8046 - DNA, 14 bp, synthetic construct
  source 1..14: mol_type = other DNA
ttctcgtctaatat

SEQ ID NO: 8047 - DNA, 14 bp, synthetic construct
  source 1..14: mol_type = other DNA
attccttccttgat

SEQ ID NO: 8048 - DNA, 14 bp, synthetic construct
  source 1..14: mol_type = other DNA
ccgctaagtttttt

SEQ ID NO: 8049 - DNA, 14 bp, synthetic construct
  source 1..14: mol_type = other DNA
ctgatttatgttgg

SEQ ID NO: 8050 - DNA, 14 bp, synthetic construct
  source 1..14: mol_type = other DNA
tttcatagatgtat

SEQ ID NO: 8051 - DNA, 14 bp, synthetic construct
  source 1..14: mol_type = other DNA
tttcttgggacttc

SEQ ID NO: 8052 - DNA, 14 bp, synthetic construct
  source 1..14: mol_type = other DNA
cgtgtgtttgactt

SEQ ID NO: 8053 - DNA, 14 bp, synthetic construct
  source 1..14: mol_type = other DNA
gtcccttcttttcc

SEQ ID NO: 8054 - DNA, 14 bp, synthetic construct
  source 1..14: mol_type = other DNA
agttatactttggt

SEQ ID NO: 8055 - DNA, 14 bp, synthetic construct
  source 1..14: mol_type = other DNA
gtggtagtttctgt

SEQ ID NO: 8056 - DNA, 14 bp, synthetic construct
  source 1..14: mol_type = other DNA
tgggctttagttat

SEQ ID NO: 8057 - DNA, 14 bp, synthetic construct
  source 1..14: mol_type = other DNA
accttgcttgttgt

SEQ ID NO: 8058 - DNA, 14 bp, synthetic construct
  source 1..14: mol_type = other DNA
gtgtaaactttctt

SEQ ID NO: 8059 - DNA, 14 bp, synthetic construct
  source 1..14: mol_type = other DNA
ttctgactgttgtc

SEQ ID NO: 8060 - DNA, 14 bp, synthetic construct
  source 1..14: mol_type = other DNA
ctgttgtcttgagt

SEQ ID NO: 8061 - DNA, 14 bp, synthetic construct
  source 1..14: mol_type = other DNA
tttgccatactgtt

SEQ ID NO: 8062 - DNA, 14 bp, synthetic construct
  source 1..14: mol_type = other DNA
ttccccatgtttgt

SEQ ID NO: 8063 - DNA, 14 bp, synthetic construct
  source 1..14: mol_type = other DNA
ttatcatctatcta

SEQ ID NO: 8064 - DNA, 14 bp, synthetic construct
  source 1..14: mol_type = other DNA
tagtttcttgcgtc

SEQ ID NO: 8065 - DNA, 14 bp, synthetic construct
  source 1..14: mol_type = other DNA
ttgggtgttactta

SEQ ID NO: 8066 - DNA, 14 bp, synthetic construct
  source 1..14: mol_type = other DNA
tgttctttgcataa

SEQ ID NO: 8067 - DNA, 14 bp, synthetic construct
  source 1..14: mol_type = other DNA
ctttctctaaaatt

SEQ ID NO: 8068 - DNA, 14 bp, synthetic construct
  source 1..14: mol_type = other DNA
tgatatagattgtt

SEQ ID NO: 8069 - DNA, 14 bp, synthetic construct
  source 1..14: mol_type = other DNA
ttactcgtgttatc

SEQ ID NO: 8070 - DNA, 14 bp, synthetic construct
  source 1..14: mol_type = other DNA
aattttctaccatt

SEQ ID NO: 8071 - DNA, 14 bp, synthetic construct
  source 1..14: mol_type = other DNA
tgtttgttactcgc

SEQ ID NO: 8072 - DNA, 14 bp, synthetic construct
  source 1..14: mol_type = other DNA
tccgtactatattt

SEQ ID NO: 8073 - DNA, 14 bp, synthetic construct
  source 1..14: mol_type = other DNA
ctactttagtgtct

SEQ ID NO: 8074 - DNA, 14 bp, synthetic construct
  source 1..14: mol_type = other DNA
tcctgctttattaa

SEQ ID NO: 8075 - DNA, 14 bp, synthetic construct
  source 1..14: mol_type = other DNA
ttattcaggtgttc

SEQ ID NO: 8076 - DNA, 14 bp, synthetic construct
  source 1..14: mol_type = other DNA
tcagtctttttgcc

SEQ ID NO: 8077 - DNA, 14 bp, synthetic construct
  source 1..14: mol_type = other DNA
ttatcctttcaact

SEQ ID NO: 8078 - DNA, 14 bp, synthetic construct
  source 1..14: mol_type = other DNA
tgctttatctctgg

SEQ ID NO: 8079 - DNA, 14 bp, synthetic construct
  source 1..14: mol_type = other DNA
ctccttctttgtaa

SEQ ID NO: 8080 - DNA, 14 bp, synthetic construct
  source 1..14: mol_type = other DNA
tcagtttcttgagt

SEQ ID NO: 8081 - DNA, 14 bp, synthetic construct
  source 1..14: mol_type = other DNA
ctcacttcttgtat

SEQ ID NO: 8082 - DNA, 14 bp, synthetic construct
  source 1..14: mol_type = other DNA
tttcatcgtgttcg

SEQ ID NO: 8083 - DNA, 14 bp, synthetic construct
  source 1..14: mol_type = other DNA
tcagagtgttttat

SEQ ID NO: 8084 - DNA, 14 bp, synthetic construct
  source 1..14: mol_type = other DNA
tagttttcgttacc

SEQ ID NO: 8085 - DNA, 19 bp, synthetic construct
  source 1..19: mol_type = other DNA
ctggagagtcacgcccaca

SEQ ID NO: 8086 - DNA, 20 bp, synthetic construct
  source 1..20: mol_type = other DNA
ctggggctgacaggcaacca

SEQ ID NO: 8087 - DNA, 22 bp, synthetic construct
  source 1..22: mol_type = other DNA
ccacacaggggaggtgatagca

SEQ ID NO: 8088 - DNA, 18 bp, synthetic construct
  source 1..18: mol_type = other DNA
ctgggcacaaccacagga

SEQ ID NO: 8089 - DNA, 17 bp, synthetic construct
  source 1..17: mol_type = other DNA
gtgaaccggcgagcaca

SEQ ID NO: 8090 - DNA, 20 bp, synthetic construct
  source 1..20: mol_type = other DNA
gtgcacttaaggacagccga

SEQ ID NO: 8091 - DNA, 22 bp, synthetic construct
  source 1..22: mol_type = other DNA
acgtcatccagcagagaatgga

SEQ ID NO: 8092 - DNA, 22 bp, synthetic construct
  source 1..22: mol_type = other DNA
aacacaggcttcacagtggcaa

SEQ ID NO: 8093 - DNA, 18 bp, synthetic construct
  source 1..18: mol_type = other DNA
tgggcagaatcccacaga

SEQ ID NO: 8094 - DNA, 18 bp, synthetic construct
  source 1..18: mol_type = other DNA
ggatctgaagccccagca

SEQ ID NO: 8095 - DNA, 20 bp, synthetic construct
  source 1..20: mol_type = other DNA
cggtaccagcggaagtggga

SEQ ID NO: 8096 - DNA, 20 bp, synthetic construct
  source 1..20: mol_type = other DNA
ctcggatccacagcagccca

SEQ ID NO: 8097 - DNA, 18 bp, synthetic construct
  source 1..18: mol_type = other DNA
cccctcagtgctacccca

SEQ ID NO: 8098 - DNA, 20 bp, synthetic construct
  source 1..20: mol_type = other DNA
gaaccacacagcaaacccca

SEQ ID NO: 8099 - DNA, 18 bp, synthetic construct
  source 1..18: mol_type = other DNA
taaccagcaggcccacca

SEQ ID NO: 8100 - DNA, 20 bp, synthetic construct
  source 1..20: mol_type = other DNA
ctggacaagagccatgacca

SEQ ID NO: 8101 - DNA, 18 bp, synthetic construct
  source 1..18: mol_type = other DNA
catctgcagagtggccga

SEQ ID NO: 8102 - DNA, 18 bp, synthetic construct
  source 1..18: mol_type = other DNA
tccgtgtacgcaaggcca

SEQ ID NO: 8103 - DNA, 22 bp, synthetic construct
  source 1..22: mol_type = other DNA
tgcatcctgctgaggaaggaga

SEQ ID NO: 8104 - DNA, 19 bp, synthetic construct
  source 1..19: mol_type = other DNA
cgggcaccagtactcagca

SEQ ID NO: 8105 - DNA, 22 bp, synthetic construct
  source 1..22: mol_type = other DNA
atctgcaatgtaagcggggaga

SEQ ID NO: 8106 - DNA, 21 bp, synthetic construct
  source 1..21: mol_type = other DNA
tcagtccaaagcctcaaagga

SEQ ID NO: 8107 - DNA, 20 bp, synthetic construct
  source 1..20: mol_type = other DNA
gagtggctcaagacccagga

SEQ ID NO: 8108 - DNA, 22 bp, synthetic construct
  source 1..22: mol_type = other DNA
agaaaagaaggatcccagcgca

SEQ ID NO: 8109 - DNA, 18 bp, synthetic construct
  source 1..18: mol_type = other DNA
ccatctggaaccgggaca

SEQ ID NO: 8110 - DNA, 20 bp, synthetic construct
  source 1..20: mol_type = other DNA
ctgggctacactgagcacca

SEQ ID NO: 8111 - DNA, 18 bp, synthetic construct
  source 1..18: mol_type = other DNA
gatggccaacaccccaga

SEQ ID NO: 8112 - DNA, 21 bp, synthetic construct
  source 1..21: mol_type = other DNA
gcaagacagtgggctggtgaa

SEQ ID NO: 8113 - DNA, 18 bp, synthetic construct
  source 1..18: mol_type = other DNA
cctcagcatccgagggca

SEQ ID NO: 8114 - DNA, 22 bp, synthetic construct
  source 1..22: mol_type = other DNA
tctggagtctagacggctcaga

SEQ ID NO: 8115 - DNA, 21 bp, synthetic construct
  source 1..21: mol_type = other DNA
atgaccagtcaacaggggaca

SEQ ID NO: 8116 - DNA, 20 bp, synthetic construct
  source 1..20: mol_type = other DNA
ccagacccactccaaccgca

SEQ ID NO: 8117 - DNA, 21 bp, synthetic construct
  source 1..21: mol_type = other DNA
aaaatacagcccgaactgcaa

SEQ ID NO: 8118 - DNA, 21 bp, synthetic construct
  source 1..21: mol_type = other DNA
gacccgagaacctcacagaga

SEQ ID NO: 8119 - DNA, 21 bp, synthetic construct
  source 1..21: mol_type = other DNA
gaagcaaggaagagcaggaga

SEQ ID NO: 8120 - DNA, 19 bp, synthetic construct
  source 1..19: mol_type = other DNA
gagagactcggctgcagga

SEQ ID NO: 8121 - DNA, 21 bp, synthetic construct
  source 1..21: mol_type = other DNA
cacccacaactaccctagcca

SEQ ID NO: 8122 - DNA, 19 bp, synthetic construct
  source 1..19: mol_type = other DNA
cacccctcacggctgcaga

SEQ ID NO: 8123 - DNA, 19 bp, synthetic construct
  source 1..19: mol_type = other DNA
ctgttgctcgggcagccca

SEQ ID NO: 8124 - DNA, 18 bp, synthetic construct
  source 1..18: mol_type = other DNA
gatggaagctgcacgcca

SEQ ID NO: 8125 - DNA, 19 bp, synthetic construct
  source 1..19: mol_type = other DNA
cggagctcatgtgccagga

SEQ ID NO: 8126 - DNA, 20 bp, synthetic construct
  source 1..20: mol_type = other DNA
ctgcttggacaatggagcca

SEQ ID NO: 8127 - DNA, 18 bp, synthetic construct
  source 1..18: mol_type = other DNA
cagtatcccgcaccccaa

SEQ ID NO: 8128 - DNA, 20 bp, synthetic construct
  source 1..20: mol_type = other DNA
tgggtcactggacccaccaa

SEQ ID NO: 8129 - DNA, 18 bp, synthetic construct
  source 1..18: mol_type = other DNA
gcatggagatccccacca

SEQ ID NO: 8130 - DNA, 20 bp, synthetic construct
  source 1..20: mol_type = other DNA
gcagagggttaaggcgcaga

SEQ ID NO: 8131 - DNA, 20 bp, synthetic construct
  source 1..20: mol_type = other DNA
ctgcaccggagaattcagga

SEQ ID NO: 8132 - DNA, 20 bp, synthetic construct
  source 1..20: mol_type = other DNA
cacactgcgctacaggagga

SEQ ID NO: 8133 - DNA, 20 bp, synthetic construct
  source 1..20: mol_type = other DNA
aagttcgcccgcagctcaca

SEQ ID NO: 8134 - DNA, 21 bp, synthetic construct
  source 1..21: mol_type = other DNA
ccacaaaaccaagcgaggcca

SEQ ID NO: 8135 - DNA, 19 bp, synthetic construct
  source 1..19: mol_type = other DNA
gtggccgcaaagaagacga

SEQ ID NO: 8136 - DNA, 22 bp, synthetic construct
  source 1..22: mol_type = other DNA
agatctatgaaggccaagtgga

SEQ ID NO: 8137 - DNA, 21 bp, synthetic construct
  source 1..21: mol_type = other DNA
ctcccacaaccctgagaccaa

SEQ ID NO: 8138 - DNA, 18 bp, synthetic construct
  source 1..18: mol_type = other DNA
tcactgtgccagcccaga

SEQ ID NO: 8139 - DNA, 19 bp, synthetic construct
  source 1..19: mol_type = other DNA
ggaagctgaaagtccccga

SEQ ID NO: 8140 - DNA, 18 bp, synthetic construct
  source 1..18: mol_type = other DNA
atacccactggcggcaca

SEQ ID NO: 8141 - DNA, 19 bp, synthetic construct
  source 1..19: mol_type = other DNA
gggaagcgtgttgcaagaa

SEQ ID NO: 8142 - DNA, 19 bp, synthetic construct
  source 1..19: mol_type = other DNA
ccaaagccttccagcgaca

SEQ ID NO: 8143 - DNA, 21 bp, synthetic construct
  source 1..21: mol_type = other DNA
ttgcacctggggaatgggaga

SEQ ID NO: 8144 - DNA, 18 bp, synthetic construct
  source 1..18: mol_type = other DNA
ccacgccagcttcggaga

SEQ ID NO: 8145 - DNA, 18 bp, synthetic construct
  source 1..18: mol_type = other DNA
ggcacgagcagctgcaga

SEQ ID NO: 8146 - DNA, 18 bp, synthetic construct
  source 1..18: mol_type = other DNA
cgatgcttggcctaccga

SEQ ID NO: 8147 - DNA, 19 bp, synthetic construct
  source 1..19: mol_type = other DNA
cccccctgagatctgagga

SEQ ID NO: 8148 - DNA, 20 bp, synthetic construct
  source 1..20: mol_type = other DNA
tagactatgaggccggcaca

SEQ ID NO: 8149 - DNA, 19 bp, synthetic construct
  source 1..19: mol_type = other DNA
ccctccagccacttcccca

SEQ ID NO: 8150 - DNA, 18 bp, synthetic construct
  source 1..18: mol_type = other DNA
gctctcacagtgccggaa

SEQ ID NO: 8151 - DNA, 20 bp, synthetic construct
  source 1..20: mol_type = other DNA
gaggaggagggcgaggacga

SEQ ID NO: 8152 - DNA, 20 bp, synthetic construct
  source 1..20: mol_type = other DNA
catccctcctgaccagcaga

SEQ ID NO: 8153 - DNA, 18 bp, synthetic construct
  source 1..18: mol_type = other DNA
ggcacatgtgtctcccca

SEQ ID NO: 8154 - DNA, 20 bp, synthetic construct
  source 1..20: mol_type = other DNA
gaccgacaaggctgcaggaa

SEQ ID NO: 8155 - DNA, 23 bp, synthetic construct
  source 1..23: mol_type = other DNA
aaaaaacagcagatggctcgaga

SEQ ID NO: 8156 - DNA, 18 bp, synthetic construct
  source 1..18: mol_type = other DNA
cctgcaaagccttcccca

SEQ ID NO: 8157 - DNA, 18 bp, synthetic construct
  source 1..18: mol_type = other DNA
catcagcgcgtccacaca

SEQ ID NO: 8158 - DNA, 18 bp, synthetic construct
  source 1..18: mol_type = other DNA
gcaggctgtgggaaggca

SEQ ID NO: 8159 - DNA, 20 bp, synthetic construct
  source 1..20: mol_type = other DNA
cactacctggggaagaccca

SEQ ID NO: 8160 - DNA, 18 bp, synthetic construct
  source 1..18: mol_type = other DNA
cttcagcagcacacccga

SEQ ID NO: 8161 - DNA, 22 bp, synthetic construct
  source 1..22: mol_type = other DNA
cagttcctgaacacggaaggaa

SEQ ID NO: 8162 - DNA, 20 bp, synthetic construct
  source 1..20: mol_type = other DNA
gggggacacattggccagca

SEQ ID NO: 8163 - DNA, 18 bp, synthetic construct
  source 1..18: mol_type = other DNA
agggctgaggaaagggga

SEQ ID NO: 8164 - DNA, 18 bp, synthetic construct
  source 1..18: mol_type = other DNA
tccgagcacacctgggca

SEQ ID NO: 8165 - DNA, 20 bp, synthetic construct
  source 1..20: mol_type = other DNA
caacgggactcaggagcaca

SEQ ID NO: 8166 - DNA, 18 bp, synthetic construct
  source 1..18: mol_type = other DNA
gcactggccatagcagca

SEQ ID NO: 8167 - DNA, 18 bp, synthetic construct
  source 1..18: mol_type = other DNA
agatggacgcactgggca

SEQ ID NO: 8168 - DNA, 18 bp, synthetic construct
  source 1..18: mol_type = other DNA
gggaggtgttcttcgcca

SEQ ID NO: 8169 - DNA, 18 bp, synthetic construct
  source 1..18: mol_type = other DNA
ttccaggagctgcagcca

SEQ ID NO: 8170 - DNA, 18 bp, synthetic construct
  source 1..18: mol_type = other DNA
tgccccacggctacgaga

SEQ ID NO: 8171 - DNA, 18 bp, synthetic construct
  source 1..18: mol_type = other DNA
tggcagaagccctggcaa

SEQ ID NO: 8172 - DNA, 18 bp, synthetic construct
  source 1..18: mol_type = other DNA
aggagtggctgatcggca

SEQ ID NO: 8173 - DNA, 20 bp, synthetic construct
  source 1..20: mol_type = other DNA
aaggaggggatgctacagca

SEQ ID NO: 8174 - DNA, 18 bp, synthetic construct
  source 1..18: mol_type = other DNA
tgatcagctggagggcga

SEQ ID NO: 8175 - DNA, 18 bp, synthetic construct
  source 1..18: mol_type = other DNA
agccattgcccatcgaga

SEQ ID NO: 8176 - DNA, 21 bp, synthetic construct
  source 1..21: mol_type = other DNA
agttacacctaagccacccta

SEQ ID NO: 8177 - DNA, 20 bp, synthetic construct
  source 1..20: mol_type = other DNA
acggacaggtaggcacgaga

SEQ ID NO: 8178 - DNA, 21 bp, synthetic construct
  source 1..21: mol_type = other DNA
aatgcaaactgaaacctggga

SEQ ID NO: 8179 - DNA, 18 bp, synthetic construct
  source 1..18: mol_type = other DNA
ccgccagattcctaccca

SEQ ID NO: 8180 - DNA, 20 bp, synthetic construct
  source 1..20: mol_type = other DNA
caaccagctccctgaccaca

SEQ ID NO: 8181 - DNA, 18 bp, synthetic construct
  source 1..18: mol_type = other DNA
ctgcgagagggaacagca

SEQ ID NO: 8182 - DNA, 18 bp, synthetic construct
  source 1..18: mol_type = other DNA
ccgcccttctgcaacaca

SEQ ID NO: 8183 - DNA, 19 bp, synthetic construct
  source 1..19: mol_type = other DNA
gatagtggaagccacccca

SEQ ID NO: 8184 - DNA, 18 bp, synthetic construct
  source 1..18: mol_type = other DNA
gagcagactgcaccccaa

SEQ ID NO: 8185 - DNA, 18 bp, synthetic construct
  source 1..18: mol_type = other DNA
acccttgctgcgaaggaa

SEQ ID NO: 8186 - DNA, 18 bp, synthetic construct
  source 1..18: mol_type = other DNA
cggaaagagcttccggga

SEQ ID NO: 8187 - DNA, 19 bp, synthetic construct
  source 1..19: mol_type = other DNA
ggggaacctcactgaccga

SEQ ID NO: 8188 - DNA, 19 bp, synthetic construct
  source 1..19: mol_type = other DNA
cctctggcacagaacccca

SEQ ID NO: 8189 - DNA, 18 bp, synthetic construct
  source 1..18: mol_type = other DNA
cgtggcaacagctcgaca

SEQ ID NO: 8190 - DNA, 21 bp, synthetic construct
  source 1..21: mol_type = other DNA
tcttcctcgccggtatacaca

SEQ ID NO: 8191 - DNA, 18 bp, synthetic construct
  source 1..18: mol_type = other DNA
ccctccggaacacaagga

SEQ ID NO: 8192 - DNA, 19 bp, synthetic construct
  source 1..19: mol_type = other DNA
ctggccgccttcacctgga

SEQ ID NO: 8193 - DNA, 18 bp, synthetic construct
  source 1..18: mol_type = other DNA
ggcagcaccacctgccaa

SEQ ID NO: 8194 - DNA, 20 bp, synthetic construct
  source 1..20: mol_type = other DNA
aagacatcgtgacgtgccaa

SEQ ID NO: 8195 - DNA, 22 bp, synthetic construct
  source 1..22: mol_type = other DNA
ccatgcaagcaggagaagagca

SEQ ID NO: 8196 - DNA, 19 bp, synthetic construct
  source 1..19: mol_type = other DNA
gggtgtgagaccgtcagga

SEQ ID NO: 8197 - DNA, 21 bp, synthetic construct
  source 1..21: mol_type = other DNA
acatggatgggcctagaagca

SEQ ID NO: 8198 - DNA, 20 bp, synthetic construct
  source 1..20: mol_type = other DNA
ctggatggggctagaagcaa

SEQ ID NO: 8199 - DNA, 19 bp, synthetic construct
  source 1..19: mol_type = other DNA
tctcatggcccacagggaa

SEQ ID NO: 8200 - DNA, 20 bp, synthetic construct
  source 1..20: mol_type = other DNA
atctaagcccagccgtggta

SEQ ID NO: 8201 - DNA, 18 bp, synthetic construct
  source 1..18: mol_type = other DNA
ccaggccgtgatggcaga

SEQ ID NO: 8202 - DNA, 18 bp, synthetic construct
  source 1..18: mol_type = other DNA
ccaagtcgctggccctca

SEQ ID NO: 8203 - DNA, 18 bp, synthetic construct
  source 1..18: mol_type = other DNA
ggtgctccgtgccacgca

SEQ ID NO: 8204 - DNA, 19 bp, synthetic construct
  source 1..19: mol_type = other DNA
ccatcagcctggaccgcta

SEQ ID NO: 8205 - DNA, 18 bp, synthetic construct
  source 1..18: mol_type = other DNA
ccacccaccaggaagcca

SEQ ID NO: 8206 - DNA, 18 bp, synthetic construct
  source 1..18: mol_type = other DNA
tccccattgccaacgcca

SEQ ID NO: 8207 - DNA, 20 bp, synthetic construct
  source 1..20: mol_type = other DNA
cagggtctcactggagcgaa

SEQ ID NO: 8208 - DNA, 17 bp, synthetic construct
  source 1..17: mol_type = other DNA
cccgccttcgacgcaca

SEQ ID NO: 8209 - DNA, 22 bp, synthetic construct
  source 1..22: mol_type = other DNA
ataacccgtgaccaagtcctga

SEQ ID NO: 8210 - DNA, 18 bp, synthetic construct
  source 1..18: mol_type = other DNA
agctggctcacccccaga

SEQ ID NO: 8211 - DNA, 20 bp, synthetic construct
  source 1..20: mol_type = other DNA
atgcagccaccatgaagaca

SEQ ID NO: 8212 - DNA, 18 bp, synthetic construct
  source 1..18: mol_type = other DNA
ttggtgaacaggcgacca

SEQ ID NO: 8213 - DNA, 20 bp, synthetic construct
  source 1..20: mol_type = other DNA
acacgatgaggcagacgaga

SEQ ID NO: 8214 - DNA, 21 bp, synthetic construct
  source 1..21: mol_type = other DNA
caaagaaggagccacacgaca

SEQ ID NO: 8215 - DNA, 18 bp, synthetic construct
  source 1..18: mol_type = other DNA
tgcatgaggcggtggaga

SEQ ID NO: 8216 - DNA, 18 bp, synthetic construct
  source 1..18: mol_type = other DNA
acagccaaggtgggacca

SEQ ID NO: 8217 - DNA, 18 bp, synthetic construct
  source 1..18: mol_type = other DNA
ctgccagggcaacgggaa

SEQ ID NO: 8218 - DNA, 18 bp, synthetic construct
  source 1..18: mol_type = other DNA
gcaggtgcaggtcgagga

SEQ ID NO: 8219 - DNA, 18 bp, synthetic construct
  source 1..18: mol_type = other DNA
gactccatgcccctgcaa

SEQ ID NO: 8220 - DNA, 21 bp, synthetic construct
  source 1..21: mol_type = other DNA
caactggagctgatggacaca

SEQ ID NO: 8221 - DNA, 20 bp, synthetic construct
  source 1..20: mol_type = other DNA
caagcaaaagaagctgggca

SEQ ID NO: 8222 - DNA, 19 bp, synthetic construct
  source 1..19: mol_type = other DNA
tcaccaccctggacagaga

SEQ ID NO: 8223 - DNA, 18 bp, synthetic construct
  source 1..18: mol_type = other DNA
gggacaagaactgcgcca

SEQ ID NO: 8224 - DNA, 22 bp, synthetic construct
  source 1..22: mol_type = other DNA
aaaccacactgcaccttcggaa

SEQ ID NO: 8225 - DNA, 22 bp, synthetic construct
  source 1..22: mol_type = other DNA
gaaagcccaagacattggagca

SEQ ID NO: 8226 - DNA, 22 bp, synthetic construct
  source 1..22: mol_type = other DNA
atccagtacggcttcaccacca

SEQ ID NO: 8227 - DNA, 20 bp, synthetic construct
  source 1..20: mol_type = other DNA
gactcagatgccgaggtgga

SEQ ID NO: 8228 - DNA, 19 bp, synthetic construct
  source 1..19: mol_type = other DNA
gctacaccctgaacccgga

SEQ ID NO: 8229 - DNA, 19 bp, synthetic construct
  source 1..19: mol_type = other DNA
gggagaaaagggctccaca

SEQ ID NO: 8230 - DNA, 18 bp, synthetic construct
  source 1..18: mol_type = other DNA
tcaacggtcagaggccca

SEQ ID NO: 8231 - DNA, 18 bp, synthetic construct
  source 1..18: mol_type = other DNA
gttacgcaccaccgggga

SEQ ID NO: 8232 - DNA, 18 bp, synthetic construct
  source 1..18: mol_type = other DNA
ccgagaaggcacagcaga

SEQ ID NO: 8233 - DNA, 18 bp, synthetic construct
  source 1..18: mol_type = other DNA
ctcgaggaagagcgggaa

SEQ ID NO: 8234 - DNA, 18 bp, synthetic construct
  source 1..18: mol_type = other DNA
ctgacctgcgcaacgaga

SEQ ID NO: 8235 - DNA, 21 bp, synthetic construct
  source 1..21: mol_type = other DNA
gccaccccagttaacctcaca

SEQ ID NO: 8236 - DNA, 18 bp, synthetic construct
  source 1..18: mol_type = other DNA
aggagcaggcccagcaga

SEQ ID NO: 8237 - DNA, 22 bp, synthetic construct
  source 1..22: mol_type = other DNA
aatggagccgtacgctatacga

SEQ ID NO: 8238 - DNA, 19 bp, synthetic construct
  source 1..19: mol_type = other DNA
ctggctactaccgaccgga

SEQ ID NO: 8239 - DNA, 19 bp, synthetic construct
  source 1..19: mol_type = other DNA
cagctgtcgtcactggcaa

SEQ ID NO: 8240 - DNA, 19 bp, synthetic construct
  source 1..19: mol_type = other DNA
cggtgtggggaaaagtcca

SEQ ID NO: 8241 - DNA, 21 bp, synthetic construct
  source 1..21: mol_type = other DNA
gtcgcatcagtgtcaggagga

SEQ ID NO: 8242 - DNA, 21 bp, synthetic construct
  source 1..21: mol_type = other DNA
catggtcaagatccccagcaa

SEQ ID NO: 8243 - DNA, 18 bp, synthetic construct
  source 1..18: mol_type = other DNA
ggtgcagccacaccagga

SEQ ID NO: 8244 - DNA, 18 bp, synthetic construct
  source 1..18: mol_type = other DNA
ccgatggcaaggagagga

SEQ ID NO: 8245 - DNA, 21 bp, synthetic construct
  source 1..21: mol_type = other DNA
ggaatgatccaggccctggga

SEQ ID NO: 8246 - DNA, 18 bp, synthetic construct
  source 1..18: mol_type = other DNA
cgctctgaagaaggccga

SEQ ID NO: 8247 - DNA, 19 bp, synthetic construct
  source 1..19: mol_type = other DNA
ccccgccaggattaacaca

SEQ ID NO: 8248 - DNA, 21 bp, synthetic construct
  source 1..21: mol_type = other DNA
gaatgtgacccccaacgtgga

SEQ ID NO: 8249 - DNA, 20 bp, synthetic construct
  source 1..20: mol_type = other DNA
cagagcctggccgagtggaa

SEQ ID NO: 8250 - DNA, 19 bp, synthetic construct
  source 1..19: mol_type = other DNA
cagccctctccctggcaga

SEQ ID NO: 8251 - DNA, 21 bp, synthetic construct
  source 1..21: mol_type = other DNA
gcttagcctggctcacgcaca

SEQ ID NO: 8252 - DNA, 20 bp, synthetic construct
  source 1..20: mol_type = other DNA
ctgcctgaatcagaagggca

SEQ ID NO: 8253 - DNA, 18 bp, synthetic construct
  source 1..18: mol_type = other DNA
gagattgcaccagcggca

SEQ ID NO: 8254 - DNA, 19 bp, synthetic construct
  source 1..19: mol_type = other DNA
cccagccagaccctaagga

SEQ ID NO: 8255 - DNA, 18 bp, synthetic construct
  source 1..18: mol_type = other DNA
agatgcgcagcaccagga

SEQ ID NO: 8256 - DNA, 21 bp, synthetic construct
  source 1..21: mol_type = other DNA
atcaccatccttccgcagcaa

SEQ ID NO: 8257 - DNA, 22 bp, synthetic construct
  source 1..22: mol_type = other DNA
gccgacagaggcagacacagaa

SEQ ID NO: 8258 - DNA, 18 bp, synthetic construct
  source 1..18: mol_type = other DNA
ggattacgacgcggcaga

SEQ ID NO: 8259 - DNA, 19 bp, synthetic construct
  source 1..19: mol_type = other DNA
gcacacccgaggaacagga

SEQ ID NO: 8260 - DNA, 18 bp, synthetic construct
  source 1..18: mol_type = other DNA
tcctgaggctccagggaa

SEQ ID NO: 8261 - DNA, 19 bp, synthetic construct
  source 1..19: mol_type = other DNA
ggggtgaactgggggagga

SEQ ID NO: 8262 - DNA, 18 bp, synthetic construct
  source 1..18: mol_type = other DNA
gttcaaccggccagccaa

SEQ ID NO: 8263 - DNA, 18 bp, synthetic construct
  source 1..18: mol_type = other DNA
ccagaaagttcggcccaa

SEQ ID NO: 8264 - DNA, 19 bp, synthetic construct
  source 1..19: mol_type = other DNA
ccaggagggaggtgtgtga

SEQ ID NO: 8265 - DNA, 19 bp, synthetic construct
  source 1..19: mol_type = other DNA
cgggcctactacaacggca

SEQ ID NO: 8266 - DNA, 18 bp, synthetic construct
  source 1..18: mol_type = other DNA
agggatgagcaaccccga

SEQ ID NO: 8267 - DNA, 18 bp, synthetic construct
  source 1..18: mol_type = other DNA
cattgcccaagcccgcaa

SEQ ID NO: 8268 - DNA, 18 bp, synthetic construct
  source 1..18: mol_type = other DNA
gggcacctcatcacacga

SEQ ID NO: 8269 - DNA, 22 bp, synthetic construct
  source 1..22: mol_type = other DNA
ctgccacaacccaatatgccaa

SEQ ID NO: 8270 - DNA, 20 bp, synthetic construct
  source 1..20: mol_type = other DNA
catccgggggcagctctgga

SEQ ID NO: 8271 - DNA, 18 bp, synthetic construct
  source 1..18: mol_type = other DNA
cgtggaccacagcaccca

SEQ ID NO: 8272 - DNA, 20 bp, synthetic construct
  source 1..20: mol_type = other DNA
ctgcaacaagagctgaccga

SEQ ID NO: 8273 - DNA, 18 bp, synthetic construct
  source 1..18: mol_type = other DNA
tggctgggagaatgacca

SEQ ID NO: 8274 - DNA, 18 bp, synthetic construct
  source 1..18: mol_type = other DNA
cgaccctccaaggacgaa

SEQ ID NO: 8275 - DNA, 18 bp, synthetic construct
  source 1..18: mol_type = other DNA
cagcccaggaaaacggca

SEQ ID NO: 8276 - DNA, 22 bp, synthetic construct
  source 1..22: mol_type = other DNA
tatcggactctaactgagccca

SEQ ID NO: 8277 - DNA, 18 bp, synthetic construct
  source 1..18: mol_type = other DNA
gagaggcggctccgggga

SEQ ID NO: 8278 - DNA, 18 bp, synthetic construct
  source 1..18: mol_type = other DNA
agcccactgccctgacca

SEQ ID NO: 8279 - DNA, 21 bp, synthetic construct
  source 1..21: mol_type = other DNA
agagtccagcccattgagaga

SEQ ID NO: 8280 - DNA, 20 bp, synthetic construct
  source 1..20: mol_type = other DNA
ggcaccggagcaggtagaga

SEQ ID NO: 8281 - DNA, 20 bp, synthetic construct
  source 1..20: mol_type = other DNA
aacgtccctagcacgaagca

SEQ ID NO: 8282 - DNA, 18 bp, synthetic construct
  source 1..18: mol_type = other DNA
gctggaacgcggacggga

SEQ ID NO: 8283 - DNA, 18 bp, synthetic construct
  source 1..18: mol_type = other DNA
acaacggccagtaccgca

SEQ ID NO: 8284 - DNA, 18 bp, synthetic construct
  source 1..18: mol_type = other DNA
ccatcaccacgtgggaga

SEQ ID NO: 8285 - DNA, 20 bp, synthetic construct
  source 1..20: mol_type = other DNA
gcagcctgtgcccagctcaa

SEQ ID NO: 8286 - DNA, 20 bp, synthetic construct
  source 1..20: mol_type = other DNA
cctaggccgacaaaagagga

SEQ ID NO: 8287 - DNA, 18 bp, synthetic construct
  source 1..18: mol_type = other DNA
gaggaccacacctgggca

SEQ ID NO: 8288 - DNA, 21 bp, synthetic construct
  source 1..21: mol_type = other DNA
ggcctctactcacgctcacga

SEQ ID NO: 8289 - DNA, 18 bp, synthetic construct
  source 1..18: mol_type = other DNA
acccctcccacctggaga

SEQ ID NO: 8290 - DNA, 20 bp, synthetic construct
  source 1..20: mol_type = other DNA
tactgcacacacatggacga

SEQ ID NO: 8291 - DNA, 20 bp, synthetic construct
  source 1..20: mol_type = other DNA
accatgagcccacaggagga

SEQ ID NO: 8292 - DNA, 18 bp, synthetic construct
  source 1..18: mol_type = other DNA
gcaggacatcgctcagca

SEQ ID NO: 8293 - DNA, 19 bp, synthetic construct
  source 1..19: mol_type = other DNA
gctagtgcagagaccgcga

SEQ ID NO: 8294 - DNA, 18 bp, synthetic construct
  source 1..18: mol_type = other DNA
agccatcgggaagcccca

SEQ ID NO: 8295 - DNA, 18 bp, synthetic construct
  source 1..18: mol_type = other DNA
ccagaatggccctgacca

SEQ ID NO: 8296 - DNA, 18 bp, synthetic construct
  source 1..18: mol_type = other DNA
ggcacctacggctgcaca

SEQ ID NO: 8297 - DNA, 20 bp, synthetic construct
  source 1..20: mol_type = other DNA
tgtggtgagggagggagaca

SEQ ID NO: 8298 - DNA, 21 bp, synthetic construct
  source 1..21: mol_type = other DNA
ctggctgagtgtggaaaccca

SEQ ID NO: 8299 - DNA, 22 bp, synthetic construct
  source 1..22: mol_type = other DNA
aagagcctaagttgccaaagga

SEQ ID NO: 8300 - DNA, 20 bp, synthetic construct
  source 1..20: mol_type = other DNA
ggcacttggatccacccaga

SEQ ID NO: 8301 - DNA, 22 bp, synthetic construct
  source 1..22: mol_type = other DNA
agaatgggtaaagacagagcga

SEQ ID NO: 8302 - DNA, 20 bp, synthetic construct
  source 1..20: mol_type = other DNA
gacgcagagaaacctgagga

SEQ ID NO: 8303 - DNA, 21 bp, synthetic construct
  source 1..21: mol_type = other DNA
aaacagttcgacactgaccga

SEQ ID NO: 8304 - DNA, 18 bp, synthetic construct
  source 1..18: mol_type = other DNA
tggaaaggctggatgcaa

SEQ ID NO: 8305 - DNA, 18 bp, synthetic construct
  source 1..18: mol_type = other DNA
acggcgtgtggaaggtga

SEQ ID NO: 8306 - DNA, 18 bp, synthetic construct
  source 1..18: mol_type = other DNA
cagcagccaacaccacca

SEQ ID NO: 8307 - DNA, 20 bp, synthetic construct
  source 1..20: mol_type = other DNA
gaggacccaaggagagcaca

SEQ ID NO: 8308 - DNA, 20 bp, synthetic construct
  source 1..20: mol_type = other DNA
gctgaggcactgcccgtcaa

SEQ ID NO: 8309 - DNA, 20 bp, synthetic construct
  source 1..20: mol_type = other DNA
cagatgcactcaacgtccca

SEQ ID NO: 8310 - DNA, 19 bp, synthetic construct
  source 1..19: mol_type = other DNA
ggaccaatgtgggccggga

SEQ ID NO: 8311 - DNA, 18 bp, synthetic construct
  source 1..18: mol_type = other DNA
agggctcgctcagccaga

SEQ ID NO: 8312 - DNA, 18 bp, synthetic construct
  source 1..18: mol_type = other DNA
gcgccaacatggaagaca

SEQ ID NO: 8313 - DNA, 22 bp, synthetic construct
  source 1..22: mol_type = other DNA
gagaccaaaccagaaacctcca

SEQ ID NO: 8314 - DNA, 18 bp, synthetic construct
  source 1..18: mol_type = other DNA
ggtgatcgcctacacgca

SEQ ID NO: 8315 - DNA, 18 bp, synthetic construct
  source 1..18: mol_type = other DNA
tctactggctgcgcgcga

SEQ ID NO: 8316 - DNA, 19 bp, synthetic construct
  source 1..19: mol_type = other DNA
taccaacgagagcggtgaa

SEQ ID NO: 8317 - DNA, 18 bp, synthetic construct
  source 1..18: mol_type = other DNA
gctgcatgaacccggtga

SEQ ID NO: 8318 - DNA, 22 bp, synthetic construct
  source 1..22: mol_type = other DNA
tgatcatcaggaccttgcagca

SEQ ID NO: 8319 - DNA, 20 bp, synthetic construct
  source 1..20: mol_type = other DNA
gtttgcgtctctcccaggaa

SEQ ID NO: 8320 - DNA, 21 bp, synthetic construct
  source 1..21: mol_type = other DNA
gcatggaccggtacatcgcca

SEQ ID NO: 8321 - DNA, 18 bp, synthetic construct
  source 1..18: mol_type = other DNA
ggcccagacggtggccaa

SEQ ID NO: 8322 - DNA, 20 bp, synthetic construct
  source 1..20: mol_type = other DNA
tgatgagccgtcagccgcaa

SEQ ID NO: 8323 - DNA, 19 bp, synthetic construct
  source 1..19: mol_type = other DNA
gctccaagccttccaacca

SEQ ID NO: 8324 - DNA, 18 bp, synthetic construct
  source 1..18: mol_type = other DNA
cgctgcgcaacacaggaa

SEQ ID NO: 8325 - DNA, 20 bp, synthetic construct
  source 1..20: mol_type = other DNA
ctggcgagacagtgagtgga

SEQ ID NO: 8326 - DNA, 21 bp, synthetic construct
  source 1..21: mol_type = other DNA
gggaactacacagtgacggga

SEQ ID NO: 8327 - DNA, 20 bp, synthetic construct
  source 1..20: mol_type = other DNA
atgggagaagagactggcca

SEQ ID NO: 8328 - DNA, 18 bp, synthetic construct
  source 1..18: mol_type = other DNA
agcacccgaacgtgacga

SEQ ID NO: 8329 - DNA, 19 bp, synthetic construct
  source 1..19: mol_type = other DNA
ccccgaatgacctgcccca

SEQ ID NO: 8330 - DNA, 20 bp, synthetic construct
  source 1..20: mol_type = other DNA
taagccacaacagcctgaca

SEQ ID NO: 8331 - DNA, 18 bp, synthetic construct
  source 1..18: mol_type = other DNA
accgtggcaacctgacca

SEQ ID NO: 8332 - DNA, 18 bp, synthetic construct
  source 1..18: mol_type = other DNA
gcggcaagtgaagcccga

SEQ ID NO: 8333 - DNA, 20 bp, synthetic construct
  source 1..20: mol_type = other DNA
ttgagatccagggcatagca

SEQ ID NO: 8334 - DNA, 19 bp, synthetic construct
  source 1..19: mol_type = other DNA
gaacaggagcaactgggca

SEQ ID NO: 8335 - DNA, 18 bp, synthetic construct
  source 1..18: mol_type = other DNA
gcactcagccaggggaca

SEQ ID NO: 8336 - DNA, 20 bp, synthetic construct
  source 1..20: mol_type = other DNA
gggaagtcagcagagggaga

SEQ ID NO: 8337 - DNA, 21 bp, synthetic construct
  source 1..21: mol_type = other DNA
cagcagggaacaaagtcagca

SEQ ID NO: 8338 - DNA, 21 bp, synthetic construct
  source 1..21: mol_type = other DNA
tgtctcacccaaatgggacca

SEQ ID NO: 8339 - DNA, 20 bp, synthetic construct
  source 1..20: mol_type = other DNA
gaggccagccttcctgcaca

SEQ ID NO: 8340 - DNA, 21 bp, synthetic construct
  source 1..21: mol_type = other DNA
gacctcagagagtgagcagga

SEQ ID NO: 8341 - DNA, 18 bp, synthetic construct
  source 1..18: mol_type = other DNA
ccagcggaactggcacga

SEQ ID NO: 8342 - DNA, 18 bp, synthetic construct
  source 1..18: mol_type = other DNA
ctgtgagagcgacgccaa

SEQ ID NO: 8343 - DNA, 18 bp, synthetic construct
  source 1..18: mol_type = other DNA
gatcgggacccagcagga

SEQ ID NO: 8344 - DNA, 17 bp, synthetic construct
  source 1..17: mol_type = other DNA
gggacatgggcagagca

SEQ ID NO: 8345 - DNA, 21 bp, synthetic construct
  source 1..21: mol_type = other DNA
ccaggaagtctggatccagga

SEQ ID NO: 8346 - DNA, 21 bp, synthetic construct
  source 1..21: mol_type = other DNA
gaagttcagcaggagcgcaga

SEQ ID NO: 8347 - DNA, 18 bp, synthetic construct
  source 1..18: mol_type = other DNA
acccactggccaccccaa

SEQ ID NO: 8348 - DNA, 21 bp, synthetic construct
  source 1..21: mol_type = other DNA
gtggtgccgactacaagcgaa

SEQ ID NO: 8349 - DNA, 18 bp, synthetic construct
  source 1..18: mol_type = other DNA
gcagatggccaacgagca

SEQ ID NO: 8350 - DNA, 17 bp, synthetic construct
  source 1..17: mol_type = other DNA
ggtgaagcagtcgccca

SEQ ID NO: 8351 - DNA, 20 bp, synthetic construct
  source 1..20: mol_type = other DNA
cgaaacctcagcaccgggga

SEQ ID NO: 8352 - DNA, 18 bp, synthetic construct
  source 1..18: mol_type = other DNA
agcagaaagcagccggga

SEQ ID NO: 8353 - DNA, 20 bp, synthetic construct
  source 1..20: mol_type = other DNA
ctgcacatcaagacaggtga

SEQ ID NO: 8354 - DNA, 18 bp, synthetic construct
  source 1..18: mol_type = other DNA
agacgccaggaggaggga

SEQ ID NO: 8355 - DNA, 18 bp, synthetic construct
  source 1..18: mol_type = other DNA
gacctccagctgtgcgga

SEQ ID NO: 8356 - DNA, 18 bp, synthetic construct
  source 1..18: mol_type = other DNA
aacccaggacgctgagga

SEQ ID NO: 8357 - DNA, 18 bp, synthetic construct
  source 1..18: mol_type = other DNA
cttgtcggcgaccaacga

SEQ ID NO: 8358 - DNA, 18 bp, synthetic construct
  source 1..18: mol_type = other DNA
cacaggtccagcgggaca

SEQ ID NO: 8359 - DNA, 18 bp, synthetic construct
  source 1..18: mol_type = other DNA
tggacctgggaaaacgca

SEQ ID NO: 8360 - DNA, 20 bp, synthetic construct
  source 1..20: mol_type = other DNA
ccaagcctgtgacacgagga

SEQ ID NO: 8361 - DNA, 18 bp, synthetic construct
  source 1..18: mol_type = other DNA
ccaaggaccctcgaggga

SEQ ID NO: 8362 - DNA, 20 bp, synthetic construct
  source 1..20: mol_type = other DNA
ctgctgagtgactcgggaca

SEQ ID NO: 8363 - DNA, 19 bp, synthetic construct
  source 1..19: mol_type = other DNA
tggacaagctgtgagacca

SEQ ID NO: 8364 - DNA, 21 bp, synthetic construct
  source 1..21: mol_type = other DNA
tcagagctgcaaatacccaca

SEQ ID NO: 8365 - DNA, 20 bp, synthetic construct
  source 1..20: mol_type = other DNA
tcagtcacagacctgcccaa

SEQ ID NO: 8366 - DNA, 18 bp, synthetic construct
  source 1..18: mol_type = other DNA
ggagcggtaagcccccaa

SEQ ID NO: 8367 - DNA, 21 bp, synthetic construct
  source 1..21: mol_type = other DNA
tgctgcggatcagctcagcta

SEQ ID NO: 8368 - DNA, 23 bp, synthetic construct
  source 1..23: mol_type = other DNA
gaaagaggacaacagcacctaca

SEQ ID NO: 8369 - DNA, 20 bp, synthetic construct
  source 1..20: mol_type = other DNA
cagcagcatctgtgaaggca

SEQ ID NO: 8370 - DNA, 20 bp, synthetic construct
  source 1..20: mol_type = other DNA
ggacaaaacgacaccagcca

SEQ ID NO: 8371 - DNA, 18 bp, synthetic construct
  source 1..18: mol_type = other DNA
agcgtgggactccatcca

SEQ ID NO: 8372 - DNA, 19 bp, synthetic construct
  source 1..19: mol_type = other DNA
catgccctaatccgggaga

SEQ ID NO: 8373 - DNA, 18 bp, synthetic construct
  source 1..18: mol_type = other DNA
cagaggccggcccgacga

SEQ ID NO: 8374 - DNA, 18 bp, synthetic construct
  source 1..18: mol_type = other DNA
acaacccgcttgagggaa

SEQ ID NO: 8375 - DNA, 19 bp, synthetic construct
  source 1..19: mol_type = other DNA
gccacccttggaggaagga

SEQ ID NO: 8376 - DNA, 19 bp, synthetic construct
  source 1..19: mol_type = other DNA
tcaacgagaaggcgatcca

SEQ ID NO: 8377 - DNA, 18 bp, synthetic construct
  source 1..18: mol_type = other DNA
cttcccccacgcagcaca

SEQ ID NO: 8378 - DNA, 19 bp, synthetic construct
  source 1..19: mol_type = other DNA
caatgccatcagacagcca

SEQ ID NO: 8379 - DNA, 19 bp, synthetic construct
  source 1..19: mol_type = other DNA
tctcagggtcccaggacaa

SEQ ID NO: 8380 - DNA, 20 bp, synthetic construct
  source 1..20: mol_type = other DNA
gcatggaccagagctggaca

SEQ ID NO: 8381 - DNA, 18 bp, synthetic construct
  source 1..18: mol_type = other DNA
gcagctccagcagacgaa

SEQ ID NO: 8382 - DNA, 18 bp, synthetic construct
  source 1..18: mol_type = other DNA
ccccggagagcaagtgca

SEQ ID NO: 8383 - DNA, 20 bp, synthetic construct
  source 1..20: mol_type = other DNA
ggcaacgagtcataccagca

SEQ ID NO: 8384 - DNA, 18 bp, synthetic construct
  source 1..18: mol_type = other DNA
ggacgagaatccccagca

SEQ ID NO: 8385 - DNA, 18 bp, synthetic construct
  source 1..18: mol_type = other DNA
agctggcacaaactcgca

SEQ ID NO: 8386 - DNA, 21 bp, synthetic construct
  source 1..21: mol_type = other DNA
ctatgaccaggccctacagca

SEQ ID NO: 8387 - DNA, 18 bp, synthetic construct
  source 1..18: mol_type = other DNA
tgcaggagaacctgggca

SEQ ID NO: 8388 - DNA, 19 bp, synthetic construct
  source 1..19: mol_type = other DNA
cccccaatgaaaggcccta

SEQ ID NO: 8389 - DNA, 19 bp, synthetic construct
  source 1..19: mol_type = other DNA
tacacgtgtacagcccaga

SEQ ID NO: 8390 - DNA, 18 bp, synthetic construct
  source 1..18: mol_type = other DNA
gaagaagcggcctcgcaa

SEQ ID NO: 8391 - DNA, 19 bp, synthetic construct
  source 1..19: mol_type = other DNA
gccgagagaacgagggcta

SEQ ID NO: 8392 - DNA, 20 bp, synthetic construct
  source 1..20: mol_type = other DNA
gctgaccttcgggaagggaa

SEQ ID NO: 8393 - DNA, 20 bp, synthetic construct
  source 1..20: mol_type = other DNA
gaaacgctgaaagccatcca

SEQ ID NO: 8394 - DNA, 18 bp, synthetic construct
  source 1..18: mol_type = other DNA
ccagcatccatcacgcca

SEQ ID NO: 8395 - DNA, 18 bp, synthetic construct
  source 1..18: mol_type = other DNA
accagcacagccagagca

SEQ ID NO: 8396 - DNA, 18 bp, synthetic construct
  source 1..18: mol_type = other DNA
agaaggggaagaggccga

SEQ ID NO: 8397 - DNA, 20 bp, synthetic construct
  source 1..20: mol_type = other DNA
ctctaactgcagccccacga

SEQ ID NO: 8398 - DNA, 18 bp, synthetic construct
  source 1..18: mol_type = other DNA
gatgcccccaatacccca

SEQ ID NO: 8399 - DNA, 20 bp, synthetic construct
  source 1..20: mol_type = other DNA
cagcacaggcacactgacca

SEQ ID NO: 8400 - DNA, 20 bp, synthetic construct
  source 1..20: mol_type = other DNA
tctgaacgccggcctgagca

SEQ ID NO: 8401 - DNA, 22 bp, synthetic construct
  source 1..22: mol_type = other DNA
cagggaaaccacccatgacgaa

SEQ ID NO: 8402 - DNA, 20 bp, synthetic construct
  source 1..20: mol_type = other DNA
cttcggaccagcctagcaga

SEQ ID NO: 8403 - DNA, 21 bp, synthetic construct
  source 1..21: mol_type = other DNA
actgtctaccaggcacacaga

SEQ ID NO: 8404 - DNA, 20 bp, synthetic construct
  source 1..20: mol_type = other DNA
cacaagcgctgagatcagga

SEQ ID NO: 8405 - DNA, 18 bp, synthetic construct
  source 1..18: mol_type = other DNA
cttgagccagctgcagca

SEQ ID NO: 8406 - DNA, 18 bp, synthetic construct
  source 1..18: mol_type = other DNA
tgacggtgatcagggcca

SEQ ID NO: 8407 - DNA, 20 bp, synthetic construct
  source 1..20: mol_type = other DNA
ggttggagtggcaggaacga

SEQ ID NO: 8408 - DNA, 19 bp, synthetic construct
  source 1..19: mol_type = other DNA
gctccgagtccatagccga

SEQ ID NO: 8409 - DNA, 18 bp, synthetic construct
  source 1..18: mol_type = other DNA
ctccaacagctcgcgaca

SEQ ID NO: 8410 - DNA, 20 bp, synthetic construct
  source 1..20: mol_type = other DNA
gtggactgggagacaagcaa

SEQ ID NO: 8411 - DNA, 18 bp, synthetic construct
  source 1..18: mol_type = other DNA
gacgcagacccaagtgca

SEQ ID NO: 8412 - DNA, 18 bp, synthetic construct
  source 1..18: mol_type = other DNA
cggttcgagtcccaggaa

SEQ ID NO: 8413 - DNA, 21 bp, synthetic construct
  source 1..21: mol_type = other DNA
agcagcagctccagttcccaa

SEQ ID NO: 8414 - DNA, 18 bp, synthetic construct
  source 1..18: mol_type = other DNA
gcaacaccaccctcagca

SEQ ID NO: 8415 - DNA, 20 bp, synthetic construct
  source 1..20: mol_type = other DNA
ctggcctcaataggaccaca

SEQ ID NO: 8416 - DNA, 18 bp, synthetic construct
  source 1..18: mol_type = other DNA
gcccagatgcccccacca

SEQ ID NO: 8417 - DNA, 20 bp, synthetic construct
  source 1..20: mol_type = other DNA
ctgtccaggaaccggacaca

SEQ ID NO: 8418 - DNA, 18 bp, synthetic construct
  source 1..18: mol_type = other DNA
tgagcggctacagcggaa

SEQ ID NO: 8419 - DNA, 21 bp, synthetic construct
  source 1..21: mol_type = other DNA
gcagcctttcacagccagcca

SEQ ID NO: 8420 - DNA, 18 bp, synthetic construct
  source 1..18: mol_type = other DNA
aggcgggtgagcaagtga

SEQ ID NO: 8421 - DNA, 21 bp, synthetic construct
  source 1..21: mol_type = other DNA
gatcggggaggactctaagca

SEQ ID NO: 8422 - DNA, 19 bp, synthetic construct
  source 1..19: mol_type = other DNA
gctacaacccccagccaga

SEQ ID NO: 8423 - DNA, 21 bp, synthetic construct
  source 1..21: mol_type = other DNA
aggaggaggacaaccgggaca

SEQ ID NO: 8424 - DNA, 20 bp, synthetic construct
  source 1..20: mol_type = other DNA
cagccctctgaacctgagca

SEQ ID NO: 8425 - DNA, 18 bp, synthetic construct
  source 1..18: mol_type = other DNA
aagccacagggagcccca

SEQ ID NO: 8426 - DNA, 18 bp, synthetic construct
  source 1..18: mol_type = other DNA
acccctgccaggacggga

SEQ ID NO: 8427 - DNA, 18 bp, synthetic construct
  source 1..18: mol_type = other DNA
cgactatccctccgggca

SEQ ID NO: 8428 - DNA, 18 bp, synthetic construct
  source 1..18: mol_type = other DNA
cataagcaccccagccca

SEQ ID NO: 8429 - DNA, 21 bp, synthetic construct
  source 1..21: mol_type = other DNA
ccggtatgacgggagcagtga

SEQ ID NO: 8430 - DNA, 21 bp, synthetic construct
  source 1..21: mol_type = other DNA
aacctctccaccacactgcaa

SEQ ID NO: 8431 - DNA, 21 bp, synthetic construct
  source 1..21: mol_type = other DNA
gagaagctgggagagacacca

SEQ ID NO: 8432 - DNA, 20 bp, synthetic construct
  source 1..20: mol_type = other DNA
ctgcgggatggcagagctga

SEQ ID NO: 8433 - DNA, 19 bp, synthetic construct
  source 1..19: mol_type = other DNA
gcatgcccagaaagctgga

SEQ ID NO: 8434 - DNA, 21 bp, synthetic construct
  source 1..21: mol_type = other DNA
tcagatccagaaggtcagcga

SEQ ID NO: 8435 - DNA, 20 bp, synthetic construct
  source 1..20: mol_type = other DNA
ctgctgcccaaccccttgga

SEQ ID NO: 8436 - DNA, 21 bp, synthetic construct
  source 1..21: mol_type = other DNA
tcaacacgccagagaaactga

SEQ ID NO: 8437 - DNA, 21 bp, synthetic construct
  source 1..21: mol_type = other DNA
gggatagcccagcaccagaca

SEQ ID NO: 8438 - DNA, 18 bp, synthetic construct
  source 1..18: mol_type = other DNA
cagccaaagccaaggcca

SEQ ID NO: 8439 - DNA, 20 bp, synthetic construct
  source 1..20: mol_type = other DNA
aaggagaagcggcgcctgga

SEQ ID NO: 8440 - DNA, 21 bp, synthetic construct
  source 1..21: mol_type = other DNA
aggcaacgaagctgggaagga

SEQ ID NO: 8441 - DNA, 19 bp, synthetic construct
  source 1..19: mol_type = other DNA
tcatacgagaaggcgacga

SEQ ID NO: 8442 - DNA, 20 bp, synthetic construct
  source 1..20: mol_type = other DNA
cgggctcagacactctgcaa

SEQ ID NO: 8443 - DNA, 18 bp, synthetic construct
  source 1..18: mol_type = other DNA
acagctgcatgaacccca

SEQ ID NO: 8444 - DNA, 18 bp, synthetic construct
  source 1..18: mol_type = other DNA
ggcgcatgctgagaagca

SEQ ID NO: 8445 - DNA, 21 bp, synthetic construct
  source 1..21: mol_type = other DNA
ggtcaccgatccctacaacga

SEQ ID NO: 8446 - DNA, 20 bp, synthetic construct
  source 1..20: mol_type = other DNA
cctgagaacaccgacctgca

SEQ ID NO: 8447 - DNA, 20 bp, synthetic construct
  source 1..20: mol_type = other DNA
cactcggcagcagtaccaga

SEQ ID NO: 8448 - DNA, 20 bp, synthetic construct
  source 1..20: mol_type = other DNA
tacgctcagtgaccaggtca

SEQ ID NO: 8449 - DNA, 18 bp, synthetic construct
  source 1..18: mol_type = other DNA
agaccacgaccagcacca

SEQ ID NO: 8450 - DNA, 18 bp, synthetic construct
  source 1..18: mol_type = other DNA
ccgcgtggtagcaaccaa

SEQ ID NO: 8451 - DNA, 20 bp, synthetic construct
  source 1..20: mol_type = other DNA
ggagacagggcacctctaca

SEQ ID NO: 8452 - DNA, 17 bp, synthetic construct
  source 1..17: mol_type = other DNA
tgagccggccagtgcca

SEQ ID NO: 8453 - DNA, 20 bp, synthetic construct
  source 1..20: mol_type = other DNA
cgcctggagctctacagcca

SEQ ID NO: 8454 - DNA, 18 bp, synthetic construct
  source 1..18: mol_type = other DNA
atggagaggctggcccaa

SEQ ID NO: 8455 - DNA, 18 bp, synthetic construct
  source 1..18: mol_type = other DNA
gcaggccaagatggacca

SEQ ID NO: 8456 - DNA, 20 bp, synthetic construct
  source 1..20: mol_type = other DNA
cagaagcccctacagagcca

SEQ ID NO: 8457 - DNA, 18 bp, synthetic construct
  source 1..18: mol_type = other DNA
ccaggcgttggaacccaa

SEQ ID NO: 8458 - DNA, 18 bp, synthetic construct
  source 1..18: mol_type = other DNA
ctggcaaagaaggcggca

SEQ ID NO: 8459 - DNA, 19 bp, synthetic construct
  source 1..19: mol_type = other DNA
gaggtcctagtggcccaca

SEQ ID NO: 8460 - DNA, 20 bp, synthetic construct
  source 1..20: mol_type = other DNA
ggtccagcgcgtgtaccaga

SEQ ID NO: 8461 - DNA, 18 bp, synthetic construct
  source 1..18: mol_type = other DNA
ggacgaagcagctggcaa

SEQ ID NO: 8462 - DNA, 20 bp, synthetic construct
  source 1..20: mol_type = other DNA
cagggcctcgaggtaacaga

SEQ ID NO: 8463 - DNA, 19 bp, synthetic construct
  source 1..19: mol_type = other DNA
cggccctactggtgaacca

SEQ ID NO: 8464 - DNA, 20 bp, synthetic construct
  source 1..20: mol_type = other DNA
ctgggcaacgtggagagaga

SEQ ID NO: 8465 - DNA, 18 bp, synthetic construct
  source 1..18: mol_type = other DNA
agggggaaaagggccaca

SEQ ID NO: 8466 - DNA, 18 bp, synthetic construct
  source 1..18: mol_type = other DNA
ccaggtgaatgagcccca

SEQ ID NO: 8467 - DNA, 20 bp, synthetic construct
  source 1..20: mol_type = other DNA
gtggtgcagtacagccacga

SEQ ID NO: 8468 - DNA, 18 bp, synthetic construct
  source 1..18: mol_type = other DNA
acagcgctgagaccacca

SEQ ID NO: 8469 - DNA, 21 bp, synthetic construct
  source 1..21: mol_type = other DNA
gaagaagcagctcctccagca

SEQ ID NO: 8470 - DNA, 18 bp, synthetic construct
  source 1..18: mol_type = other DNA
gaatgcccagtgcaccca

SEQ ID NO: 8471 - DNA, 18 bp, synthetic construct
  source 1..18: mol_type = other DNA
tcgaggcgagaagggaga

SEQ ID NO: 8472 - DNA, 18 bp, synthetic construct
  source 1..18: mol_type = other DNA
tgatgcctgcgacgacga

SEQ ID NO: 8473 - DNA, 18 bp, synthetic construct
  source 1..18: mol_type = other DNA
cgccggaaatgaggccga

SEQ ID NO: 8474 - DNA, 18 bp, synthetic construct
  source 1..18: mol_type = other DNA
ggacctacagccagggca

SEQ ID NO: 8475 - DNA, 18 bp, synthetic construct
  source 1..18: mol_type = other DNA
cctgggcagcatgaagga

SEQ ID NO: 8476 - DNA, 20 bp, synthetic construct
  source 1..20: mol_type = other DNA
gaagccgtcaaaaagcctga

SEQ ID NO: 8477 - DNA, 18 bp, synthetic construct
  source 1..18: mol_type = other DNA
cagggccatcatggagga

SEQ ID NO: 8478 - DNA, 18 bp, synthetic construct
  source 1..18: mol_type = other DNA
acagcttcacgggaggca

SEQ ID NO: 8479 - DNA, 18 bp, synthetic construct
  source 1..18: mol_type = other DNA
atgtgacccccacccaga

SEQ ID NO: 8480 - DNA, 19 bp, synthetic construct
  source 1..19: mol_type = other DNA
ccctgggccagaaagagga

SEQ ID NO: 8481 - DNA, 21 bp, synthetic construct
  source 1..21: mol_type = other DNA
catgggactgggaagtcagca

SEQ ID NO: 8482 - DNA, 18 bp, synthetic construct
  source 1..18: mol_type = other DNA
caccatctccacgctgga

SEQ ID NO: 8483 - DNA, 20 bp, synthetic construct
  source 1..20: mol_type = other DNA
atctgcacagcctgtgacga

SEQ ID NO: 8484 - DNA, 20 bp, synthetic construct
  source 1..20: mol_type = other DNA
cagaacccctcacgcaccca

SEQ ID NO: 8485 - DNA, 20 bp, synthetic construct
  source 1..20: mol_type = other DNA
ccgctaccgagtggaggaca

SEQ ID NO: 8486 - DNA, 21 bp, synthetic construct
  source 1..21: mol_type = other DNA
caccaacgcctcccaaaccaa

SEQ ID NO: 8487 - DNA, 21 bp, synthetic construct
  source 1..21: mol_type = other DNA
gtgcctaacgtaaccctgcaa

SEQ ID NO: 8488 - DNA, 18 bp, synthetic construct
  source 1..18: mol_type = other DNA
gcgagggttccagggaga

SEQ ID NO: 8489 - DNA, 18 bp, synthetic construct
  source 1..18: mol_type = other DNA
ggagcaccagggatcgga

SEQ ID NO: 8490 - DNA, 20 bp, synthetic construct
  source 1..20: mol_type = other DNA
gaaacccaggaggctggaga

SEQ ID NO: 8491 - DNA, 19 bp, synthetic construct
  source 1..19: mol_type = other DNA
gagccgacctgcctacaga

SEQ ID NO: 8492 - DNA, 20 bp, synthetic construct
  source 1..20: mol_type = other DNA
gagctcctggagtgaagcca

SEQ ID NO: 8493 - DNA, 18 bp, synthetic construct
  source 1..18: mol_type = other DNA
tccagaacgcccacagca

SEQ ID NO: 8494 - DNA, 18 bp, synthetic construct
  source 1..18: mol_type = other DNA
cacgccacccatcaccaa

SEQ ID NO: 8495 - DNA, 20 bp, synthetic construct
  source 1..20: mol_type = other DNA
agtacgaggtccagcgggca

SEQ ID NO: 8496 - DNA, 21 bp, synthetic construct
  source 1..21: mol_type = other DNA
ctgcgagtccatcatcaccga

SEQ ID NO: 8497 - DNA, 20 bp, synthetic construct
  source 1..20: mol_type = other DNA
gctgaacctggctaccagga

SEQ ID NO: 8498 - DNA, 20 bp, synthetic construct
  source 1..20: mol_type = other DNA
gtgaggccattgtggacaca

SEQ ID NO: 8499 - DNA, 18 bp, synthetic construct
  source 1..18: mol_type = other DNA
gcaggggagatcatcgga

SEQ ID NO: 8500 - DNA, 18 bp, synthetic construct
  source 1..18: mol_type = other DNA
aacccaacaggcaaggca

SEQ ID NO: 8501 - DNA, 20 bp, synthetic construct
  source 1..20: mol_type = other DNA
caactccatgaacaaccgga

SEQ ID NO: 8502 - DNA, 19 bp, synthetic construct
  source 1..19: mol_type = other DNA
ccaaagagccgtacgtcca

SEQ ID NO: 8503 - DNA, 20 bp, synthetic construct
  source 1..20: mol_type = other DNA
ggaccctcaagctgaatgga

SEQ ID NO: 8504 - DNA, 19 bp, synthetic construct
  source 1..19: mol_type = other DNA
ggacccatgggttcaggaa

SEQ ID NO: 8505 - DNA, 18 bp, synthetic construct
  source 1..18: mol_type = other DNA
agccagggcccatcgcca

SEQ ID NO: 8506 - DNA, 20 bp, synthetic construct
  source 1..20: mol_type = other DNA
gctcaccagtccctccccaa

SEQ ID NO: 8507 - DNA, 20 bp, synthetic construct
  source 1..20: mol_type = other DNA
atctacgccttcattggcca

SEQ ID NO: 8508 - DNA, 20 bp, synthetic construct
  source 1..20: mol_type = other DNA
cagctctgaggactgcacca

SEQ ID NO: 8509 - DNA, 20 bp, synthetic construct
  source 1..20: mol_type = other DNA
gccaacgtcagtgaggcaga

SEQ ID NO: 8510 - DNA, 20 bp, synthetic construct
  source 1..20: mol_type = other DNA
gagaaccaagcagaaacgca

SEQ ID NO: 8511 - DNA, 21 bp, synthetic construct
  source 1..21: mol_type = other DNA
cagaggccatcgcatacctga

SEQ ID NO: 8512 - DNA, 17 bp, synthetic construct
  source 1..17: mol_type = other DNA
ggacggcccaactggga

SEQ ID NO: 8513 - DNA, 19 bp, synthetic construct
  source 1..19: mol_type = other DNA
ccccgaagtccagacagca

SEQ ID NO: 8514 - DNA, 18 bp, synthetic construct
  source 1..18: mol_type = other DNA
ctgccacatgccatgaca

SEQ ID NO: 8515 - DNA, 20 bp, synthetic construct
  source 1..20: mol_type = other DNA
gcctgcaagaccgaggctga

SEQ ID NO: 8516 - DNA, 19 bp, synthetic construct
  source 1..19: mol_type = other DNA
ggctgctccctgaaccaga

SEQ ID NO: 8517 - DNA, 18 bp, synthetic construct
  source 1..18: mol_type = other DNA
gcctatgtggggaagcca

SEQ ID NO: 8518 - DNA, 20 bp, synthetic construct
  source 1..20: mol_type = other DNA
gttccctgtcagacaagcga

SEQ ID NO: 8519 - DNA, 18 bp, synthetic construct
  source 1..18: mol_type = other DNA
atgtcagggcaccccaca

SEQ ID NO: 8520 - DNA, 18 bp, synthetic construct
  source 1..18: mol_type = other DNA
gtccatgcaggaggcaca

SEQ ID NO: 8521 - DNA, 18 bp, synthetic construct
  source 1..18: mol_type = other DNA
tctggccaacacgcctca

SEQ ID NO: 8522 - DNA, 21 bp, synthetic construct
  source 1..21: mol_type = other DNA
aaactccaggttggcccacaa

SEQ ID NO: 8523 - DNA, 19 bp, synthetic construct
  source 1..19: mol_type = other DNA
gccagctctctacccccaa

SEQ ID NO: 8524 - DNA, 18 bp, synthetic construct
  source 1..18: mol_type = other DNA
cgagatctggccacacga

SEQ ID NO: 8525 - DNA, 18 bp, synthetic construct
  source 1..18: mol_type = other DNA
cacctgccatggagggga

SEQ ID NO: 8526 - DNA, 18 bp, synthetic construct
  source 1..18: mol_type = other DNA
gatggagccttggaccga

SEQ ID NO: 8527 - DNA, 18 bp, synthetic construct
  source 1..18: mol_type = other DNA
gctgcacggatctcgaga

SEQ ID NO: 8528 - DNA, 20 bp, synthetic construct
  source 1..20: mol_type = other DNA
gaggtgcggacatccatcga

SEQ ID NO: 8529 - DNA, 20 bp, synthetic construct
  source 1..20: mol_type = other DNA
tcggggggtaggaaaggaca

SEQ ID NO: 8530 - DNA, 18 bp, synthetic construct
  source 1..18: mol_type = other DNA
caccaacatgccacggca

SEQ ID NO: 8531 - DNA, 18 bp, synthetic construct
  source 1..18: mol_type = other DNA
cccaagcgcctcaagaca

SEQ ID NO: 8532 - DNA, 20 bp, synthetic construct
  source 1..20: mol_type = other DNA
ctcaggttgcctagcaggaa

SEQ ID NO: 8533 - DNA, 18 bp, synthetic construct
  source 1..18: mol_type = other DNA
agggaagcaccctggaca

SEQ ID NO: 8534 - DNA, 18 bp, synthetic construct
  source 1..18: mol_type = other DNA
cctgcaccaacaaggcca

SEQ ID NO: 8535 - DNA, 19 bp, synthetic construct
  source 1..19: mol_type = other DNA
ttgcagtggctcaggagga

SEQ ID NO: 8536 - DNA, 18 bp, synthetic construct
  source 1..18: mol_type = other DNA
cctgaccttcgccagcaa

SEQ ID NO: 8537 - DNA, 20 bp, synthetic construct
  source 1..20: mol_type = other DNA
agggagaacatgtacgggga

SEQ ID NO: 8538 - DNA, 18 bp, synthetic construct
  source 1..18: mol_type = other DNA
ctgcagggaagcacagca

SEQ ID NO: 8539 - DNA, 19 bp, synthetic construct
  source 1..19: mol_type = other DNA
gaccaagacatggccacca

SEQ ID NO: 8540 - DNA, 19 bp, synthetic construct
  source 1..19: mol_type = other DNA
ggcgctaagaccggacaga

SEQ ID NO: 8541 - DNA, 19 bp, synthetic construct
  source 1..19: mol_type = other DNA
cctgctccaaactccacca

SEQ ID NO: 8542 - DNA, 18 bp, synthetic construct
  source 1..18: mol_type = other DNA
cacacgctcctcacccaa

SEQ ID NO: 8543 - DNA, 22 bp, synthetic construct
  source 1..22: mol_type = other DNA
aagcagcgtcgagaagtggcaa

SEQ ID NO: 8544 - DNA, 18 bp, synthetic construct
  source 1..18: mol_type = other DNA
tcagaagcgaggggagca

SEQ ID NO: 8545 - DNA, 18 bp, synthetic construct
  source 1..18: mol_type = other DNA
tcacagtcctcaggccca

SEQ ID NO: 8546 - DNA, 18 bp, synthetic construct
  source 1..18: mol_type = other DNA
gcccatcccccaggagga

SEQ ID NO: 8547 - DNA, 18 bp, synthetic construct
  source 1..18: mol_type = other DNA
catgagtcagccgagcca

SEQ ID NO: 8548 - DNA, 18 bp, synthetic construct
  source 1..18: mol_type = other DNA
ccaggagttcagccccaa

SEQ ID NO: 8549 - DNA, 19 bp, synthetic construct
  source 1..19: mol_type = other DNA
ccgctaaggactgcggaca

SEQ ID NO: 8550 - DNA, 20 bp, synthetic construct
  source 1..20: mol_type = other DNA
ctgggaaggagaacctgcca

SEQ ID NO: 8551 - DNA, 18 bp, synthetic construct
  source 1..18: mol_type = other DNA
ggggtgcaggagaggaga

SEQ ID NO: 8552 - DNA, 19 bp, synthetic construct
  source 1..19: mol_type = other DNA
gctactcctccagccccga

SEQ ID NO: 8553 - DNA, 20 bp, synthetic construct
  source 1..20: mol_type = other DNA
caggagccgccagtccccaa

SEQ ID NO: 8554 - DNA, 21 bp, synthetic construct
  source 1..21: mol_type = other DNA
agaagcactcagatgagggga

SEQ ID NO: 8555 - DNA, 20 bp, synthetic construct
  source 1..20: mol_type = other DNA
cgccccgagatcccaacaga

SEQ ID NO: 8556 - DNA, 18 bp, synthetic construct
  source 1..18: mol_type = other DNA
acggtccccttcgacaga

SEQ ID NO: 8557 - DNA, 18 bp, synthetic construct
  source 1..18: mol_type = other DNA
gcagaggttgcagagcca

SEQ ID NO: 8558 - DNA, 19 bp, synthetic construct
  source 1..19: mol_type = other DNA
ccgggtctcaagaccagga

SEQ ID NO: 8559 - DNA, 21 bp, synthetic construct
  source 1..21: mol_type = other DNA
caacccaaagaggatcgccaa

SEQ ID NO: 8560 - DNA, 20 bp, synthetic construct
  source 1..20: mol_type = other DNA
caccggctcctaataacgga

SEQ ID NO: 8561 - DNA, 21 bp, synthetic construct
  source 1..21: mol_type = other DNA
tgagccatcccatgcagagga

SEQ ID NO: 8562 - DNA, 19 bp, synthetic construct
  source 1..19: mol_type = other DNA
ttgagcccagttgctgcaa

SEQ ID NO: 8563 - DNA, 18 bp, synthetic construct
  source 1..18: mol_type = other DNA
caagatccagggcagcga

SEQ ID NO: 8564 - DNA, 22 bp, synthetic construct
  source 1..22: mol_type = other DNA
gaatggctcaaaacttgggaga

SEQ ID NO: 8565 - DNA, 18 bp, synthetic construct
  source 1..18: mol_type = other DNA
tgaccaagccaccaagca

SEQ ID NO: 8566 - DNA, 18 bp, synthetic construct
  source 1..18: mol_type = other DNA
actgcttgccaaccccca

SEQ ID NO: 8567 - DNA, 18 bp, synthetic construct
  source 1..18: mol_type = other DNA
ctgtgcagtggatggcga

SEQ ID NO: 8568 - DNA, 18 bp, synthetic construct
  source 1..18: mol_type = other DNA
gtgagccatgcagcccaa

SEQ ID NO: 8569 - DNA, 18 bp, synthetic construct
  source 1..18: mol_type = other DNA
tcggacagctgccaggaa

SEQ ID NO: 8570 - DNA, 19 bp, synthetic construct
  source 1..19: mol_type = other DNA
tcgagcacgtacagcagca

SEQ ID NO: 8571 - DNA, 23 bp, synthetic construct
  source 1..23: mol_type = other DNA
caaaatggtccagtacagggaca

SEQ ID NO: 8572 - DNA, 18 bp, synthetic construct
  source 1..18: mol_type = other DNA
catgggccagttcgacca

SEQ ID NO: 8573 - DNA, 20 bp, synthetic construct
  source 1..20: mol_type = other DNA
ctgaaggtgggctacaccga

SEQ ID NO: 8574 - DNA, 18 bp, synthetic construct
  source 1..18: mol_type = other DNA
gcggctaaacgacggaca

SEQ ID NO: 8575 - DNA, 20 bp, synthetic construct
  source 1..20: mol_type = other DNA
tggcacagtctacaagggca

SEQ ID NO: 8576 - DNA, 20 bp, synthetic construct
  source 1..20: mol_type = other DNA
atgaaccggaggagaaggca

SEQ ID NO: 8577 - DNA, 21 bp, synthetic construct
  source 1..21: mol_type = other DNA
tggcccaagagctcagacaca

SEQ ID NO: 8578 - DNA, 22 bp, synthetic construct
  source 1..22: mol_type = other DNA
atgcccacggacatggaacaca

SEQ ID NO: 8579 - DNA, 18 bp, synthetic construct
  source 1..18: mol_type = other DNA
ggaaacgtccagcaccga

SEQ ID NO: 8580 - DNA, 20 bp, synthetic construct
  source 1..20: mol_type = other DNA
acactcatcagcaccccaga

SEQ ID NO: 8581 - DNA, 21 bp, synthetic construct
  source 1..21: mol_type = other DNA
acacgggaagacactgggaca

SEQ ID NO: 8582 - DNA, 18 bp, synthetic construct
  source 1..18: mol_type = other DNA
tccaccgtgcagtgggaa

SEQ ID NO: 8583 - DNA, 18 bp, synthetic construct
  source 1..18: mol_type = other DNA
cggatgcagagatcggca

SEQ ID NO: 8584 - DNA, 18 bp, synthetic construct
  source 1..18: mol_type = other DNA
gcacctggccacggcaga

SEQ ID NO: 8585 - DNA, 25 bp, synthetic construct
  source 1..25: mol_type = other DNA
gacggacacaaactaagggatgcca

SEQ ID NO: 8586 - DNA, 20 bp, synthetic construct
  source 1..20: mol_type = other DNA
gagtgtgacctcaccgacga

SEQ ID NO: 8587 - DNA, 18 bp, synthetic construct
  source 1..18: mol_type = other DNA
gcagggatgcaaacgcca

SEQ ID NO: 8588 - DNA, 18 bp, synthetic construct
  source 1..18: mol_type = other DNA
tgggctttgccaccagga

SEQ ID NO: 8589 - DNA, 21 bp, synthetic construct
  source 1..21: mol_type = other DNA
ctggaagctgaccaacagtca

SEQ ID NO: 8590 - DNA, 18 bp, synthetic construct
  source 1..18: mol_type = other DNA
cccagcttccctgaacga

SEQ ID NO: 8591 - DNA, 18 bp, synthetic construct
  source 1..18: mol_type = other DNA
gaggcaacagcaccgcaa

SEQ ID NO: 8592 - DNA, 18 bp, synthetic construct
  source 1..18: mol_type = other DNA
ggagggaaggccggggaa

SEQ ID NO: 8593 - DNA, 18 bp, synthetic construct
  source 1..18: mol_type = other DNA
ccctcaaggcagccgtga

SEQ ID NO: 8594 - DNA, 18 bp, synthetic construct
  source 1..18: mol_type = other DNA
gtggcaagtgggaggcca

SEQ ID NO: 8595 - DNA, 21 bp, synthetic construct
  source 1..21: mol_type = other DNA
tcagaacttggaaggcctgca

SEQ ID NO: 8596 - DNA, 19 bp, synthetic construct
  source 1..19: mol_type = other DNA
gcctccactaccgctgcca

SEQ ID NO: 8597 - DNA, 18 bp, synthetic construct
  source 1..18: mol_type = other DNA
gaattccaccgaggccga

SEQ ID NO: 8598 - DNA, 18 bp, synthetic construct
  source 1..18: mol_type = other DNA
ggagatgcacagcagcga

SEQ ID NO: 8599 - DNA, 19 bp, synthetic construct
  source 1..19: mol_type = other DNA
ggcactctggtaggcacca

SEQ ID NO: 8600 - DNA, 18 bp, synthetic construct
  source 1..18: mol_type = other DNA
gctacaccatgacggcca

SEQ ID NO: 8601 - DNA, 18 bp, synthetic construct
  source 1..18: mol_type = other DNA
taaccaccgctgccagca

SEQ ID NO: 8602 - DNA, 21 bp, synthetic construct
  source 1..21: mol_type = other DNA
tgagctgtgccccaaagacga

SEQ ID NO: 8603 - DNA, 18 bp, synthetic construct
  source 1..18: mol_type = other DNA
cgcatggccgtggcagga

SEQ ID NO: 8604 - DNA, 18 bp, synthetic construct
  source 1..18: mol_type = other DNA
ggtggtgatggagggcca

SEQ ID NO: 8605 - DNA, 18 bp, synthetic construct
  source 1..18: mol_type = other DNA
tgacgacatggaagggca

SEQ ID NO: 8606 - DNA, 18 bp, synthetic construct
  source 1..18: mol_type = other DNA
ctgcgaggcaggaacaca

SEQ ID NO: 8607 - DNA, 20 bp, synthetic construct
  source 1..20: mol_type = other DNA
ctcatccaagcctgtgacca

SEQ ID NO: 8608 - DNA, 20 bp, synthetic construct
  source 1..20: mol_type = other DNA
ctcatccaagcctgtgacca

SEQ ID NO: 8609 - DNA, 20 bp, synthetic construct
  source 1..20: mol_type = other DNA
agcatcagccccaatgccca

SEQ ID NO: 8610 - DNA, 18 bp, synthetic construct
  source 1..18: mol_type = other DNA
agctggcatgcggactga

SEQ ID NO: 8611 - DNA, 21 bp, synthetic construct
  source 1..21: mol_type = other DNA
cccggtgcagctagaagtcca

SEQ ID NO: 8612 - DNA, 18 bp, synthetic construct
  source 1..18: mol_type = other DNA
ggccccaacagtgacgga

SEQ ID NO: 8613 - DNA, 20 bp, synthetic construct
  source 1..20: mol_type = other DNA
gaggacaggtgatggaggga

SEQ ID NO: 8614 - DNA, 21 bp, synthetic construct
  source 1..21: mol_type = other DNA
ctactcctgtgaggccaacaa

SEQ ID NO: 8615 - DNA, 21 bp, synthetic construct
  source 1..21: mol_type = other DNA
ccagatctggagcatccagca

SEQ ID NO: 8616 - DNA, 19 bp, synthetic construct
  source 1..19: mol_type = other DNA
gcagtggcctctgacccca

SEQ ID NO: 8617 - DNA, 20 bp, synthetic construct
  source 1..20: mol_type = other DNA
caggtggagagcagtgccca

SEQ ID NO: 8618 - DNA, 20 bp, synthetic construct
  source 1..20: mol_type = other DNA
aagcagaaggagcagcgaga

SEQ ID NO: 8619 - DNA, 19 bp, synthetic construct
  source 1..19: mol_type = other DNA
gggggctcctatgacccaa

SEQ ID NO: 8620 - DNA, 18 bp, synthetic construct
  source 1..18: mol_type = other DNA
gctcgtccagccaaagca

SEQ ID NO: 8621 - DNA, 18 bp, synthetic construct
  source 1..18: mol_type = other DNA
cctgggctcacggggaga

SEQ ID NO: 8622 - DNA, 19 bp, synthetic construct
  source 1..19: mol_type = other DNA
ctggaccagtactccccca

SEQ ID NO: 8623 - DNA, 19 bp, synthetic construct
  source 1..19: mol_type = other DNA
tcaacggcagacaccccca

SEQ ID NO: 8624 - DNA, 18 bp, synthetic construct
  source 1..18: mol_type = other DNA
cgccaactgcacacacga

SEQ ID NO: 8625 - DNA, 20 bp, synthetic construct
  source 1..20: mol_type = other DNA
gaccgggtgtacacacacca

SEQ ID NO: 8626 - DNA, 18 bp, synthetic construct
  source 1..18: mol_type = other DNA
gccttggcgccaacacca

SEQ ID NO: 8627 - DNA, 24 bp, synthetic construct
  source 1..24: mol_type = other DNA
taactataatggcacagctggaga

SEQ ID NO: 8628 - DNA, 20 bp, synthetic construct
  source 1..20: mol_type = other DNA
gaccaccggcaggatgtgga

SEQ ID NO: 8629 - DNA, 20 bp, synthetic construct
  source 1..20: mol_type = other DNA
tacaaccggggcagcaggaa

SEQ ID NO: 8630 - DNA, 19 bp, synthetic construct
  source 1..19: mol_type = other DNA
tcctgactgggatggcaga

SEQ ID NO: 8631 - DNA, 19 bp, synthetic construct
  source 1..19: mol_type = other DNA
tctggcacccctgtaacca

SEQ ID NO: 8632 - DNA, 18 bp, synthetic construct
  source 1..18: mol_type = other DNA
tcgcagaagcatcggcaa

SEQ ID NO: 8633 - DNA, 18 bp, synthetic construct
  source 1..18: mol_type = other DNA
gctcgggactcagtggga

SEQ ID NO: 8634 - DNA, 18 bp, synthetic construct
  source 1..18: mol_type = other DNA
caacaaggtgggccagga

SEQ ID NO: 8635 - DNA, 22 bp, synthetic construct
  source 1..22: mol_type = other DNA
gaggaaatagccctgtccagga

SEQ ID NO: 8636 - DNA, 21 bp, synthetic construct
  source 1..21: mol_type = other DNA
tccacgtgcaggccatctcca

SEQ ID NO: 8637 - DNA, 18 bp, synthetic construct
  source 1..18: mol_type = other DNA
atgctccaagcagccaca

SEQ ID NO: 8638 - DNA, 20 bp, synthetic construct
  source 1..20: mol_type = other DNA
cagcaactacagccgaggga

SEQ ID NO: 8639 - DNA, 18 bp, synthetic construct
  source 1..18: mol_type = other DNA
cctgaaaggggaccccca

SEQ ID NO: 8640 - DNA, 18 bp, synthetic construct
  source 1..18: mol_type = other DNA
gttcagggggcggcagca

SEQ ID NO: 8641 - DNA, 18 bp, synthetic construct
  source 1..18: mol_type = other DNA
ctcgctgggcaacaacca

SEQ ID NO: 8642 - DNA, 18 bp, synthetic construct
  source 1..18: mol_type = other DNA
ctacgccaccaatccgca

SEQ ID NO: 8643 - DNA, 20 bp, synthetic construct
  source 1..20: mol_type = other DNA
catcctgccacctggaagaa

SEQ ID NO: 8644 - DNA, 21 bp, synthetic construct
  source 1..21: mol_type = other DNA
tgccaccaagatccacaagca

SEQ ID NO: 8645 - DNA, 21 bp, synthetic construct
  source 1..21: mol_type = other DNA
gcaccgtctggctcaaagaga

SEQ ID NO: 8646 - DNA, 21 bp, synthetic construct
  source 1..21: mol_type = other DNA
agacacttcagtccccggcaa

SEQ ID NO: 8647 - DNA, 21 bp, synthetic construct
  source 1..21: mol_type = other DNA
tggaccgcaccaagaggcaga

SEQ ID NO: 8648 - DNA, 20 bp, synthetic construct
  source 1..20: mol_type = other DNA
atccagtggctggaagctga

SEQ ID NO: 8649 - DNA, 20 bp, synthetic construct
  source 1..20: mol_type = other DNA
gaagggtgtggtgggcgaca

SEQ ID NO: 8650 - DNA, 18 bp, synthetic construct
  source 1..18: mol_type = other DNA
gaactcgcagcacctgga

SEQ ID NO: 8651 - DNA, 21 bp, synthetic construct
  source 1..21: mol_type = other DNA
accccgactacatcaccgaga

SEQ ID NO: 8652 - DNA, 18 bp, synthetic construct
  source 1..18: mol_type = other DNA
tccccgcagtgaaaacca

SEQ ID NO: 8653 - DNA, 18 bp, synthetic construct
  source 1..18: mol_type = other DNA
acccccatcccaagtcga

SEQ ID NO: 8654 - DNA, 21 bp, synthetic construct
  source 1..21: mol_type = other DNA
gccaatcaatcggaaaggaga

SEQ ID NO: 8655 - DNA, 18 bp, synthetic construct
  source 1..18: mol_type = other DNA
tcgggagaccttgcccaa

SEQ ID NO: 8656 - DNA, 18 bp, synthetic construct
  source 1..18: mol_type = other DNA
gctctctgaccaccccga

SEQ ID NO: 8657 - DNA, 22 bp, synthetic construct
  source 1..22: mol_type = other DNA
gtgacgtggaatccacacaaga

SEQ ID NO: 8658 - DNA, 18 bp, synthetic construct
  source 1..18: mol_type = other DNA
tgagccctcccacatgca

SEQ ID NO: 8659 - DNA, 20 bp, synthetic construct
  source 1..20: mol_type = other DNA
atgccaccacctaaaaggca

SEQ ID NO: 8660 - DNA, 18 bp, synthetic construct
  source 1..18: mol_type = other DNA
ctgggaggcacaggagca

SEQ ID NO: 8661 - DNA, 20 bp, synthetic construct
  source 1..20: mol_type = other DNA
ctcactggaggacttcccca

SEQ ID NO: 8662 - DNA, 20 bp, synthetic construct
  source 1..20: mol_type = other DNA
cggcggcggtaacttcgaca

SEQ ID NO: 8663 - DNA, 19 bp, synthetic construct
  source 1..19: mol_type = other DNA
ggactccaggcgtgcccaa

SEQ ID NO: 8664 - DNA, 18 bp, synthetic construct
  source 1..18: mol_type = other DNA
ccgtcgcagtcggaccaa

SEQ ID NO: 8665 - DNA, 18 bp, synthetic construct
  source 1..18: mol_type = other DNA
agccatccctgtccccaa

SEQ ID NO: 8666 - DNA, 18 bp, synthetic construct
  source 1..18: mol_type = other DNA
tcgggaactccaggagca

SEQ ID NO: 8667 - DNA, 18 bp, synthetic construct
  source 1..18: mol_type = other DNA
gcacagtcatgaccccca

SEQ ID NO: 8668 - DNA, 21 bp, synthetic construct
  source 1..21: mol_type = other DNA
gcttcacagagctcacgacaa

SEQ ID NO: 8669 - DNA, 20 bp, synthetic construct
  source 1..20: mol_type = other DNA
tgagccctgaacaccagaga

SEQ ID NO: 8670 - DNA, 18 bp, synthetic construct
  source 1..18: mol_type = other DNA
gcaggaagccaaggagca

SEQ ID NO: 8671 - DNA, 21 bp, synthetic construct
  source 1..21: mol_type = other DNA
ggaggtagccacattgggcca

SEQ ID NO: 8672 - DNA, 18 bp, synthetic construct
  source 1..18: mol_type = other DNA
cggagaaactgcccagca

SEQ ID NO: 8673 - DNA, 18 bp, synthetic construct
  source 1..18: mol_type = other DNA
cgagtgggagatcgccaa

SEQ ID NO: 8674 - DNA, 19 bp, synthetic construct
  source 1..19: mol_type = other DNA
gtggggtgctccaagggca

SEQ ID NO: 8675 - DNA, 20 bp, synthetic construct
  source 1..20: mol_type = other DNA
acttagcccagcggcctgca

SEQ ID NO: 8676 - DNA, 18 bp, synthetic construct
  source 1..18: mol_type = other DNA
ccagctgcagaccctcga

SEQ ID NO: 8677 - DNA, 18 bp, synthetic construct
  source 1..18: mol_type = other DNA
cttcaggcacgctggaga

SEQ ID NO: 8678 - DNA, 18 bp, synthetic construct
  source 1..18: mol_type = other DNA
caaccacagcagctggca

SEQ ID NO: 8679 - DNA, 19 bp, synthetic construct
  source 1..19: mol_type = other DNA
caggcactcaatctgggca

SEQ ID NO: 8680 - DNA, 19 bp, synthetic construct
  source 1..19: mol_type = other DNA
gggtgtgagacacacgcca

SEQ ID NO: 8681 - DNA, 22 bp, synthetic construct
  source 1..22: mol_type = other DNA
taaaacaaccgcttgtggccga

SEQ ID NO: 8682 - DNA, 18 bp, synthetic construct
  source 1..18: mol_type = other DNA
agggagcattcccacgga

SEQ ID NO: 8683 - DNA, 18 bp, synthetic construct
  source 1..18: mol_type = other DNA
ccaccgaggagggcacga

SEQ ID NO: 8684 - DNA, 20 bp, synthetic construct
  source 1..20: mol_type = other DNA
tgccgggtactactacgcca

SEQ ID NO: 8685 - DNA, 20 bp, synthetic construct
  source 1..20: mol_type = other DNA
ccactcctcagaaccagtga

SEQ ID NO: 8686 - DNA, 22 bp, synthetic construct
  source 1..22: mol_type = other DNA
atgaggaagagagtgaggccaa

SEQ ID NO: 8687 - DNA, 21 bp, synthetic construct
  source 1..21: mol_type = other DNA
tgcggccaaacccaagcacga

SEQ ID NO: 8688 - DNA, 21 bp, synthetic construct
  source 1..21: mol_type = other DNA
ctgcaaccggaaagtctacca

SEQ ID NO: 8689 - DNA, 19 bp, synthetic construct
  source 1..19: mol_type = other DNA
tcacgggctggaagagaca

SEQ ID NO: 8690 - DNA, 18 bp, synthetic construct
  source 1..18: mol_type = other DNA
gctgcaacagtcgcacca

SEQ ID NO: 8691 - DNA, 25 bp, synthetic construct
  source 1..25: mol_type = other DNA
atgaggaacaaggcaaggctgtcaa

SEQ ID NO: 8692 - DNA, 19 bp, synthetic construct
  source 1..19: mol_type = other DNA
gctgtgacctcaccagcca

SEQ ID NO: 8693 - DNA, 20 bp, synthetic construct
  source 1..20: mol_type = other DNA
caaagccctgtccacacgca

SEQ ID NO: 8694 - DNA, 18 bp, synthetic construct
  source 1..18: mol_type = other DNA
ctgccgagacaaccgaca

SEQ ID NO: 8695 - DNA, 18 bp, synthetic construct
  source 1..18: mol_type = other DNA
aggcacagctcaggccaa

SEQ ID NO: 8696 - DNA, 22 bp, synthetic construct
  source 1..22: mol_type = other DNA
aaacgggacacatatgcagcca

SEQ ID NO: 8697 - DNA, 21 bp, synthetic construct
  source 1..21: mol_type = other DNA
gaggtggaagagactcgtgca

SEQ ID NO: 8698 - DNA, 22 bp, synthetic construct
  source 1..22: mol_type = other DNA
gcaggaagatcgaaagtgcgaa

SEQ ID NO: 8699 - DNA, 20 bp, synthetic construct
  source 1..20: mol_type = other DNA
gaggagatcatcgggggcca

SEQ ID NO: 8700 - DNA, 20 bp, synthetic construct
  source 1..20: mol_type = other DNA
tcaggaaggtcaccggccga

SEQ ID NO: 8701 - DNA, 22 bp, synthetic construct
  source 1..22: mol_type = other DNA
aagagaaccagacgcaggaaga

SEQ ID NO: 8702 - DNA, 18 bp, synthetic construct
  source 1..18: mol_type = other DNA
ccaacgtacccgccgaca

SEQ ID NO: 8703 - DNA, 20 bp, synthetic construct
  source 1..20: mol_type = other DNA
aacccacgtcacctatcgga

SEQ ID NO: 8704 - DNA, 19 bp, synthetic construct
  source 1..19: mol_type = other DNA
ggcaacgtggtgctcagga

SEQ ID NO: 8705 - DNA, 21 bp, synthetic construct
  source 1..21: mol_type = other DNA
tgcaagcggaagagtcccgaa

SEQ ID NO: 8706 - DNA, 18 bp, synthetic construct
  source 1..18: mol_type = other DNA
ccccggagaccgaggaga

SEQ ID NO: 8707 - DNA, 19 bp, synthetic construct
  source 1..19: mol_type = other DNA
tcaccatgatgccacccaa

SEQ ID NO: 8708 - DNA, 19 bp, synthetic construct
  source 1..19: mol_type = other DNA
gggagggtgggtgcctcca

SEQ ID NO: 8709 - DNA, 21 bp, synthetic construct
  source 1..21: mol_type = other DNA
ctggattggagagcagcagaa

SEQ ID NO: 8710 - DNA, 23 bp, synthetic construct
  source 1..23: mol_type = other DNA
gaaaacaagtcagaggaccagca

SEQ ID NO: 8711 - DNA, 20 bp, synthetic construct
  source 1..20: mol_type = other DNA
gaagccaggaggagcagaca

SEQ ID NO: 8712 - DNA, 20 bp, synthetic construct
  source 1..20: mol_type = other DNA
ccccacccccatgtccacca

SEQ ID NO: 8713 - DNA, 18 bp, synthetic construct
  source 1..18: mol_type = other DNA
aggctgcgtgcagcgaca

SEQ ID NO: 8714 - DNA, 20 bp, synthetic construct
  source 1..20: mol_type = other DNA
gtgccttctggacaagagca

SEQ ID NO: 8715 - DNA, 19 bp, synthetic construct
  source 1..19: mol_type = other DNA
ctgaatgggcaggaggaga

SEQ ID NO: 8716 - DNA, 20 bp, synthetic construct
  source 1..20: mol_type = other DNA
ctgggaggcccaagagccaa

SEQ ID NO: 8717 - DNA, 20 bp, synthetic construct
  source 1..20: mol_type = other DNA
gtggagcacaccagcctgga

SEQ ID NO: 8718 - DNA, 20 bp, synthetic construct
  source 1..20: mol_type = other DNA
tatgactgcaaggtggagca

SEQ ID NO: 8719 - DNA, 25 bp, synthetic construct
  source 1..25: mol_type = other DNA
aaggtgcatcaccatctacaggaga

SEQ ID NO: 8720 - DNA, 18 bp, synthetic construct
  source 1..18: mol_type = other DNA
ccagcctccagagcccca

SEQ ID NO: 8721 - DNA, 20 bp, synthetic construct
  source 1..20: mol_type = other DNA
gcggagcatcgaggactgga

SEQ ID NO: 8722 - DNA, 20 bp, synthetic construct
  source 1..20: mol_type = other DNA
gagagagcccaacgtcctca

SEQ ID NO: 8723 - DNA, 21 bp, synthetic construct
  source 1..21: mol_type = other DNA
acaagccctctcacagtggaa

SEQ ID NO: 8724 - DNA, 21 bp, synthetic construct
  source 1..21: mol_type = other DNA
gtccacaggcctgattcagaa

SEQ ID NO: 8725 - DNA, 20 bp, synthetic construct
  source 1..20: mol_type = other DNA
cgccagggacaccgcacaga

SEQ ID NO: 8726 - DNA, 20 bp, synthetic construct
  source 1..20: mol_type = other DNA
gaccgagtggccctgaggaa

SEQ ID NO: 8727 - DNA, 19 bp, synthetic construct
  source 1..19: mol_type = other DNA
gggggaccagactcccaga

SEQ ID NO: 8728 - DNA, 19 bp, synthetic construct
  source 1..19: mol_type = other DNA
gctcggagccaccaagaga

SEQ ID NO: 8729 - DNA, 21 bp, synthetic construct
  source 1..21: mol_type = other DNA
tctcccatcaaaggacgtgca

SEQ ID NO: 8730 - DNA, 19 bp, synthetic construct
  source 1..19: mol_type = other DNA
gctgaccaagaccaatgca

SEQ ID NO: 8731 - DNA, 18 bp, synthetic construct
  source 1..18: mol_type = other DNA
ccaagccacgtggacaga

SEQ ID NO: 8732 - DNA, 22 bp, synthetic construct
  source 1..22: mol_type = other DNA
ctgaagcagagcaatggaagca

SEQ ID NO: 8733 - DNA, 20 bp, synthetic construct
  source 1..20: mol_type = other DNA
gcagaagcgagtcccaggga

SEQ ID NO: 8734 - DNA, 18 bp, synthetic construct
  source 1..18: mol_type = other DNA
cagtgccctggaacgcaa

SEQ ID NO: 8735 - DNA, 18 bp, synthetic construct
  source 1..18: mol_type = other DNA
caccggaaaaggtggcaa

SEQ ID NO: 8736 - DNA, 18 bp, synthetic construct
  source 1..18: mol_type = other DNA
cggggtacaccacaagca

SEQ ID NO: 8737 - DNA, 21 bp, synthetic construct
  source 1..21: mol_type = other DNA
tgaatacgagggggagtacga

SEQ ID NO: 8738 - DNA, 18 bp, synthetic construct
  source 1..18: mol_type = other DNA
caagaaccagacccggga

SEQ ID NO: 8739 - DNA, 20 bp, synthetic construct
  source 1..20: mol_type = other DNA
cacaaacactcagccccgaa

SEQ ID NO: 8740 - DNA, 18 bp, synthetic construct
  source 1..18: mol_type = other DNA
gtccagctcacgaggcaa

SEQ ID NO: 8741 - DNA, 20 bp, synthetic construct
  source 1..20: mol_type = other DNA
tacctgcccaagtcaccaga

SEQ ID NO: 8742 - DNA, 22 bp, synthetic construct
  source 1..22: mol_type = other DNA
aaggggggcaaatactctgcga

SEQ ID NO: 8743 - DNA, 18 bp, synthetic construct
  source 1..18: mol_type = other DNA
agccgctaccggaaccga

SEQ ID NO: 8744 - DNA, 19 bp, synthetic construct
  source 1..19: mol_type = other DNA
gaaaggcaacccccagcta

SEQ ID NO: 8745 - DNA, 18 bp, synthetic construct
  source 1..18: mol_type = other DNA
catgcacgccaacgccca

SEQ ID NO: 8746 - DNA, 18 bp, synthetic construct
  source 1..18: mol_type = other DNA
ccgcagccgcaggtggaa

SEQ ID NO: 8747 - DNA, 18 bp, synthetic construct
  source 1..18: mol_type = other DNA
cccggagtccgaggagga

SEQ ID NO: 8748 - DNA, 21 bp, synthetic construct
  source 1..21: mol_type = other DNA
ctgacttgaatgtccaacgca

SEQ ID NO: 8749 - DNA, 23 bp, synthetic construct
  source 1..23: mol_type = other DNA
aaaatactcacgcagaaggaaga

SEQ ID NO: 8750 - DNA, 19 bp, synthetic construct
  source 1..19: mol_type = other DNA
ctacccggacctccagcca

SEQ ID NO: 8751 - DNA, 18 bp, synthetic construct
  source 1..18: mol_type = other DNA
ccaggaacaacggggaga

SEQ ID NO: 8752 - DNA, 18 bp, synthetic construct
  source 1..18: mol_type = other DNA
ccgtggcatcgttgagga

SEQ ID NO: 8753 - DNA, 20 bp, synthetic construct
  source 1..20: mol_type = other DNA
gacgacgggcagatgcacaa

SEQ ID NO: 8754 - DNA, 18 bp, synthetic construct
  source 1..18: mol_type = other DNA
caagttccaccccctcca

SEQ ID NO: 8755 - DNA, 18 bp, synthetic construct
  source 1..18: mol_type = other DNA
gactgctgagcagcggca

SEQ ID NO: 8756 - DNA, 20 bp, synthetic construct
  source 1..20: mol_type = other DNA
gaggctcagagacagacgga

SEQ ID NO: 8757 - DNA, 20 bp, synthetic construct
  source 1..20: mol_type = other DNA
ggttctcaaccgcaccagca

SEQ ID NO: 8758 - DNA, 18 bp, synthetic construct
  source 1..18: mol_type = other DNA
ggtggagcgaccagagga

SEQ ID NO: 8759 - DNA, 20 bp, synthetic construct
  source 1..20: mol_type = other DNA
cagctgcagtgacctgggaa

SEQ ID NO: 8760 - DNA, 20 bp, synthetic construct
  source 1..20: mol_type = other DNA
aaagctggggaatggagtga

SEQ ID NO: 8761 - DNA, 18 bp, synthetic construct
  source 1..18: mol_type = other DNA
aggccaaggccaccagga

SEQ ID NO: 8762 - DNA, 18 bp, synthetic construct
  source 1..18: mol_type = other DNA
ctgctccaactggccaca

SEQ ID NO: 8763 - DNA, 18 bp, synthetic construct
  source 1..18: mol_type = other DNA
cccgagggagccagctca

SEQ ID NO: 8764 - DNA, 20 bp, synthetic construct
  source 1..20: mol_type = other DNA
aacaagggcattgaagcgaa

SEQ ID NO: 8765 - DNA, 21 bp, synthetic construct
  source 1..21: mol_type = other DNA
gctgcatcaacgctgatggga

SEQ ID NO: 8766 - DNA, 18 bp, synthetic construct
  source 1..18: mol_type = other DNA
tcgccctgggcctacaga

SEQ ID NO: 8767 - DNA, 19 bp, synthetic construct
  source 1..19: mol_type = other DNA
ggccgtcagaagcaggaga

SEQ ID NO: 8768 - DNA, 18 bp, synthetic construct
  source 1..18: mol_type = other DNA
gtggcaagagcgagggca

SEQ ID NO: 8769 - DNA, 19 bp, synthetic construct
  source 1..19: mol_type = other DNA
ctccactgcgctaccggga

SEQ ID NO: 8770 - DNA, 18 bp, synthetic construct
  source 1..18: mol_type = other DNA
ggctgatatcccaggcca

SEQ ID NO: 8771 - DNA, 19 bp, synthetic construct
  source 1..19: mol_type = other DNA
cgttgcaggagacggagga

SEQ ID NO: 8772 - DNA, 18 bp, synthetic construct
  source 1..18: mol_type = other DNA
ccccgcatcaacctgaca

SEQ ID NO: 8773 - DNA, 19 bp, synthetic construct
  source 1..19: mol_type = other DNA
cgggaccttgaggagccaa

SEQ ID NO: 8774 - DNA, 21 bp, synthetic construct
  source 1..21: mol_type = other DNA
ggacttcacggagcagtcaca

SEQ ID NO: 8775 - DNA, 18 bp, synthetic construct
  source 1..18: mol_type = other DNA
ccggcctggatatggaca

SEQ ID NO: 8776 - DNA, 20 bp, synthetic construct
  source 1..20: mol_type = other DNA
gctgagtggggtgaagggaa

SEQ ID NO: 8777 - DNA, 18 bp, synthetic construct
  source 1..18: mol_type = other DNA
agaggtcccaaggcacca

SEQ ID NO: 8778 - DNA, 19 bp, synthetic construct
  source 1..19: mol_type = other DNA
cacgggaagacaaggtgga

SEQ ID NO: 8779 - DNA, 21 bp, synthetic construct
  source 1..21: mol_type = other DNA
gtcctgaagtgtaacacccca

SEQ ID NO: 8780 - DNA, 20 bp, synthetic construct
  source 1..20: mol_type = other DNA
ccggactgactgggaccaca

SEQ ID NO: 8781 - DNA, 21 bp, synthetic construct
  source 1..21: mol_type = other DNA
caacaggcgtcaacagtacga

SEQ ID NO: 8782 - DNA, 22 bp, synthetic construct
  source 1..22: mol_type = other DNA
aggaggaggaggaggtagagga

SEQ ID NO: 8783 - DNA, 21 bp, synthetic construct
  source 1..21: mol_type = other DNA
agcaaagacacactggggaga

SEQ ID NO: 8784 - DNA, 18 bp, synthetic construct
  source 1..18: mol_type = other DNA
tccacccccatgcaggca

SEQ ID NO: 8785 - DNA, 18 bp, synthetic construct
  source 1..18: mol_type = other DNA
gcgctgtggagacgcgga

SEQ ID NO: 8786 - DNA, 21 bp, synthetic construct
  source 1..21: mol_type = other DNA
taatagctcaggggagatgga

SEQ ID NO: 8787 - DNA, 20 bp, synthetic construct
  source 1..20: mol_type = other DNA
gaccaaggaggaggcgccaa

SEQ ID NO: 8788 - DNA, 18 bp, synthetic construct
  source 1..18: mol_type = other DNA
gcaggtggggcaggtgga

SEQ ID NO: 8789 - DNA, 18 bp, synthetic construct
  source 1..18: mol_type = other DNA
cggtcaacgagtcagcca

SEQ ID NO: 8790 - DNA, 18 bp, synthetic construct
  source 1..18: mol_type = other DNA
gggtcacccctcagcaca

SEQ ID NO: 8791 - DNA, 23 bp, synthetic construct
  source 1..23: mol_type = other DNA
cagcaaaagcgcaggaagagaga

SEQ ID NO: 8792 - DNA, 18 bp, synthetic construct
  source 1..18: mol_type = other DNA
gacaacgaggtgcagcca

SEQ ID NO: 8793 - DNA, 21 bp, synthetic construct
  source 1..21: mol_type = other DNA
ccaactcagccaatccgcaca

SEQ ID NO: 8794 - DNA, 20 bp, synthetic construct
  source 1..20: mol_type = other DNA
caggtggggatggtaagaca

SEQ ID NO: 8795 - DNA, 21 bp, synthetic construct
  source 1..21: mol_type = other DNA
cagaacctgactgaaccccca

SEQ ID NO: 8796 - DNA, 21 bp, synthetic construct
  source 1..21: mol_type = other DNA
gcttgttccccatccacggga

SEQ ID NO: 8797 - DNA, 18 bp, synthetic construct
  source 1..18: mol_type = other DNA
agagttgccccgagcaca

SEQ ID NO: 8798 - DNA, 18 bp, synthetic construct
  source 1..18: mol_type = other DNA
gatggacgcagccaacga

SEQ ID NO: 8799 - DNA, 18 bp, synthetic construct
  source 1..18: mol_type = other DNA
caggccatcatccccaca

SEQ ID NO: 8800 - DNA, 21 bp, synthetic construct
  source 1..21: mol_type = other DNA
cggagccagcatactaccgaa

SEQ ID NO: 8801 - DNA, 20 bp, synthetic construct
  source 1..20: mol_type = other DNA
gggactcaactgcaccacca

SEQ ID NO: 8802 - DNA, 18 bp, synthetic construct
  source 1..18: mol_type = other DNA
ggctgccaaatgcaggca

SEQ ID NO: 8803 - DNA, 18 bp, synthetic construct
  source 1..18: mol_type = other DNA
catgcagtctgagcggga

SEQ ID NO: 8804 - DNA, 22 bp, synthetic construct
  source 1..22: mol_type = other DNA
caaagaggaggaggttggacca

SEQ ID NO: 8805 - DNA, 18 bp, synthetic construct
  source 1..18: mol_type = other DNA
gatggctgacgtggccaa

SEQ ID NO: 8806 - DNA, 20 bp, synthetic construct
  source 1..20: mol_type = other DNA
ctcatgcccacagagggaga

SEQ ID NO: 8807 - DNA, 18 bp, synthetic construct
  source 1..18: mol_type = other DNA
tggcagaggtgtcccgaa

SEQ ID NO: 8808 - DNA, 20 bp, synthetic construct
  source 1..20: mol_type = other DNA
ctcgagtacgtgccacacca

SEQ ID NO: 8809 - DNA, 18 bp, synthetic construct
  source 1..18: mol_type = other DNA
gcaaggtgagcgggacca

SEQ ID NO: 8810 - DNA, 20 bp, synthetic construct
  source 1..20: mol_type = other DNA
gagggacctgcctgtcagca

SEQ ID NO: 8811 - DNA, 22 bp, synthetic construct
  source 1..22: mol_type = other DNA
accaaggtagaaagtcgggaca

SEQ ID NO: 8812 - DNA, 18 bp, synthetic construct
  source 1..18: mol_type = other DNA
tgagcgctacaacggcca

SEQ ID NO: 8813 - DNA, 19 bp, synthetic construct
  source 1..19: mol_type = other DNA
ggggagccctacatgacga

SEQ ID NO: 8814 - DNA, 19 bp, synthetic construct
  source 1..19: mol_type = other DNA
cggaggaccagaagggcaa

SEQ ID NO: 8815 - DNA, 18 bp, synthetic construct
  source 1..18: mol_type = other DNA
tggccagatctgcagcga

SEQ ID NO: 8816 - DNA, 18 bp, synthetic construct
  source 1..18: mol_type = other DNA
atccctcctgcagcggaa

SEQ ID NO: 8817 - DNA, 18 bp, synthetic construct
  source 1..18: mol_type = other DNA
atgcgagagacaccggga

SEQ ID NO: 8818 - DNA, 18 bp, synthetic construct
  source 1..18: mol_type = other DNA
ttcagcagcagcccagca

SEQ ID NO: 8819 - DNA, 18 bp, synthetic construct
  source 1..18: mol_type = other DNA
agaagccagaggccagca

SEQ ID NO: 8820 - DNA, 20 bp, synthetic construct
  source 1..20: mol_type = other DNA
gtggactgcaaggacccaga

SEQ ID NO: 8821 - DNA, 19 bp, synthetic construct
  source 1..19: mol_type = other DNA
cgcaaggtgcctgaggcca

SEQ ID NO: 8822 - DNA, 18 bp, synthetic construct
  source 1..18: mol_type = other DNA
ggtgccaagtgccaggaa

SEQ ID NO: 8823 - DNA, 18 bp, synthetic construct
  source 1..18: mol_type = other DNA
ctgcgaccagtacggcaa

SEQ ID NO: 8824 - DNA, 21 bp, synthetic construct
  source 1..21: mol_type = other DNA
tgacaagaagtgatgcgggga

SEQ ID NO: 8825 - DNA, 20 bp, synthetic construct
  source 1..20: mol_type = other DNA
caggtgtgaggagcaggaga

SEQ ID NO: 8826 - DNA, 18 bp, synthetic construct
  source 1..18: mol_type = other DNA
gcccggaagagcctcgaa

SEQ ID NO: 8827 - DNA, 18 bp, synthetic construct
  source 1..18: mol_type = other DNA
cgagctggccgaacgaca

SEQ ID NO: 8828 - DNA, 19 bp, synthetic construct
  source 1..19: mol_type = other DNA
gagcccagtcagagaccca

SEQ ID NO: 8829 - DNA, 20 bp, synthetic construct
  source 1..20: mol_type = other DNA
aagaggctgttacggcacca

SEQ ID NO: 8830 - DNA, 19 bp, synthetic construct
  source 1..19: mol_type = other DNA
tcccagttccaacaagcca

SEQ ID NO: 8831 - DNA, 18 bp, synthetic construct
  source 1..18: mol_type = other DNA
acccccgacacctgcaca

SEQ ID NO: 8832 - DNA, 21 bp, synthetic construct
  source 1..21: mol_type = other DNA
caacggaacattccaggccga

SEQ ID NO: 8833 - DNA, 23 bp, synthetic construct
  source 1..23: mol_type = other DNA
ctgcctgctggagagaaaacaca

SEQ ID NO: 8834 - DNA, 21 bp, synthetic construct
  source 1..21: mol_type = other DNA
ccaaggttcaggcaggagaga

SEQ ID NO: 8835 - DNA, 23 bp, synthetic construct
  source 1..23: mol_type = other DNA
ggaaagagcagccaaaatcccaa

SEQ ID NO: 8836 - DNA, 20 bp, synthetic construct
  source 1..20: mol_type = other DNA
gtggatggcacctgaaagca

SEQ ID NO: 8837 - DNA, 23 bp, synthetic construct
  source 1..23: mol_type = other DNA
caaaactgaagggatctgcagga

SEQ ID NO: 8838 - DNA, 18 bp, synthetic construct
  source 1..18: mol_type = other DNA
cccacagactcaggccca

SEQ ID NO: 8839 - DNA, 22 bp, synthetic construct
  source 1..22: mol_type = other DNA
aaacccaaagaggcagcaacga

SEQ ID NO: 8840 - DNA, 22 bp, synthetic construct
  source 1..22: mol_type = other DNA
ggtttactgccacctccagaga

SEQ ID NO: 8841 - DNA, 21 bp, synthetic construct
  source 1..21: mol_type = other DNA
cagcatttactccaggaccca

SEQ ID NO: 8842 - DNA, 22 bp, synthetic construct
  source 1..22: mol_type = other DNA
aaagaaaaggagttctgcccaa

SEQ ID NO: 8843 - DNA, 21 bp, synthetic construct
  source 1..21: mol_type = other DNA
caggaaatgagcctgctccaa

SEQ ID NO: 8844 - DNA, 20 bp, synthetic construct
  source 1..20: mol_type = other DNA
gtctcgacacagctgggaga

SEQ ID NO: 8845 - DNA, 18 bp, synthetic construct
  source 1..18: mol_type = other DNA
ccgtggggaagaggagca

SEQ ID NO: 8846 - DNA, 18 bp, synthetic construct
  source 1..18: mol_type = other DNA
ctggagaatgtgccccga

SEQ ID NO: 8847 - DNA, 21 bp, synthetic construct
  source 1..21: mol_type = other DNA
ggagcctcgtgactacagcaa

SEQ ID NO: 8848 - DNA, 20 bp, synthetic construct
  source 1..20: mol_type = other DNA
aggccccccgtgtggacaca

SEQ ID NO: 8849 - DNA, 18 bp, synthetic construct
  source 1..18: mol_type = other DNA
ggctcggaagaaccgaga

SEQ ID NO: 8850 - DNA, 21 bp, synthetic construct
  source 1..21: mol_type = other DNA
aactccagtcccatctcagca

SEQ ID NO: 8851 - DNA, 18 bp, synthetic construct
  source 1..18: mol_type = other DNA
gtcccagatgcagacgca

SEQ ID NO: 8852 - DNA, 21 bp, synthetic construct
  source 1..21: mol_type = other DNA
ggctggagtctgggatgcaga

SEQ ID NO: 8853 - DNA, 18 bp, synthetic construct
  source 1..18: mol_type = other DNA
ggagaggatgttccggca

SEQ ID NO: 8854 - DNA, 20 bp, synthetic construct
  source 1..20: mol_type = other DNA
gtgcccaacgctctgggaga

SEQ ID NO: 8855 - DNA, 18 bp, synthetic construct
  source 1..18: mol_type = other DNA
gccgtcggacaacagtca

SEQ ID NO: 8856 - DNA, 18 bp, synthetic construct
  source 1..18: mol_type = other DNA
ccgcctggagagggagga

SEQ ID NO: 8857 - DNA, 20 bp, synthetic construct
  source 1..20: mol_type = other DNA
cagtgacacctgtgacccca

SEQ ID NO: 8858 - DNA, 20 bp, synthetic construct
  source 1..20: mol_type = other DNA
gtggagctcactgatgggca

SEQ ID NO: 8859 - DNA, 18 bp, synthetic construct
  source 1..18: mol_type = other DNA
actcggtggcagtcacca

SEQ ID NO: 8860 - DNA, 19 bp, synthetic construct
  source 1..19: mol_type = other DNA
cctggaccctgaggacaca

SEQ ID NO: 8861 - DNA, 18 bp, synthetic construct
  source 1..18: mol_type = other DNA
acgcgcagagcaaccaca

SEQ ID NO: 8862 - DNA, 18 bp, synthetic construct
  source 1..18: mol_type = other DNA
gccagtgcgacaaagcca

SEQ ID NO: 8863 - DNA, 18 bp, synthetic construct
  source 1..18: mol_type = other DNA
tcacacagggggtgagca

SEQ ID NO: 8864 - DNA, 18 bp, synthetic construct
  source 1..18: mol_type = other DNA
ccgacactgatgcagcca

SEQ ID NO: 8865 - DNA, 18 bp, synthetic construct
  source 1..18: mol_type = other DNA
tcacgtgactggccagga

SEQ ID NO: 8866 - DNA, 20 bp, synthetic construct
  source 1..20: mol_type = other DNA
cagagctggaagagagggca

SEQ ID NO: 8867 - DNA, 20 bp, synthetic construct
  source 1..20: mol_type = other DNA
gagcacgtccgtgtcacgaa

SEQ ID NO: 8868 - DNA, 22 bp, synthetic construct
  source 1..22: mol_type = other DNA
tgcagctgaacatcactcagga

SEQ ID NO: 8869 - DNA, 19 bp, synthetic construct
  source 1..19: mol_type = other DNA
gcctccagttgtcagccca

SEQ ID NO: 8870 - DNA, 18 bp, synthetic construct
  source 1..18: mol_type = other DNA
cagcacacaaccacccga

SEQ ID NO: 8871 - DNA, 18 bp, synthetic construct
  source 1..18: mol_type = other DNA
aggagggaggcaggacca

SEQ ID NO: 8872 - DNA, 20 bp, synthetic construct
  source 1..20: mol_type = other DNA
ctgtggacagagcaagcaca

SEQ ID NO: 8873 - DNA, 18 bp, synthetic construct
  source 1..18: mol_type = other DNA
acctccccaccatccaga

SEQ ID NO: 8874 - DNA, 21 bp, synthetic construct
  source 1..21: mol_type = other DNA
acatgctcacgggagtctcca

SEQ ID NO: 8875 - DNA, 20 bp, synthetic construct
  source 1..20: mol_type = other DNA
gaagctggagggactgcaca

SEQ ID NO: 8876 - DNA, 18 bp, synthetic construct
  source 1..18: mol_type = other DNA
caccctcagcccatcaca

SEQ ID NO: 8877 - DNA, 20 bp, synthetic construct
  source 1..20: mol_type = other DNA
caccaagctcagcagaacca

SEQ ID NO: 8878 - DNA, 21 bp, synthetic construct
  source 1..21: mol_type = other DNA
ccacggtgacctcaggagaga

SEQ ID NO: 8879 - DNA, 18 bp, synthetic construct
  source 1..18: mol_type = other DNA
ctgtgacccccagccaca

SEQ ID NO: 8880 - DNA, 18 bp, synthetic construct
  source 1..18: mol_type = other DNA
gacatcgacgtcagggca

SEQ ID NO: 8881 - DNA, 18 bp, synthetic construct
  source 1..18: mol_type = other DNA
cctgaactcccagcccca

SEQ ID NO: 8882 - DNA, 21 bp, synthetic construct
  source 1..21: mol_type = other DNA
ccagctgctgacgtccaggaa

SEQ ID NO: 8883 - DNA, 19 bp, synthetic construct
  source 1..19: mol_type = other DNA
ctacagggtcagtccccca

SEQ ID NO: 8884 - DNA, 20 bp, synthetic construct
  source 1..20: mol_type = other DNA
ctggtctacaccgaggagga

SEQ ID NO: 8885 - DNA, 18 bp, synthetic construct
  source 1..18: mol_type = other DNA
acacgcccgacgaggaga

SEQ ID NO: 8886 - DNA, 18 bp, synthetic construct
  source 1..18: mol_type = other DNA
cacagccattgtccgcaa

SEQ ID NO: 8887 - DNA, 20 bp, synthetic construct
  source 1..20: mol_type = other DNA
gaactcagcctacacccgaa

SEQ ID NO: 8888 - DNA, 18 bp, synthetic construct
  source 1..18: mol_type = other DNA
cggcatggtgggcgacga

SEQ ID NO: 8889 - DNA, 18 bp, synthetic construct
  source 1..18: mol_type = other DNA
atggactggccctacgga

SEQ ID NO: 8890 - DNA, 20 bp, synthetic construct
  source 1..20: mol_type = other DNA
cgaaaggtccgccgtcacca

SEQ ID NO: 8891 - DNA, 20 bp, synthetic construct
  source 1..20: mol_type = other DNA
cagttcaccaccgctgggga

SEQ ID NO: 8892 - DNA, 21 bp, synthetic construct
  source 1..21: mol_type = other DNA
agggcttccagcaccaacgga

SEQ ID NO: 8893 - DNA, 19 bp, synthetic construct
  source 1..19: mol_type = other DNA
ctcactgcccctagagcca

SEQ ID NO: 8894 - DNA, 21 bp, synthetic construct
  source 1..21: mol_type = other DNA
gcagcctactccacaggagga

SEQ ID NO: 8895 - DNA, 25 bp, synthetic construct
  source 1..25: mol_type = other DNA
tcaaggacaagggcttagacaacca

SEQ ID NO: 8896 - DNA, 21 bp, synthetic construct
  source 1..21: mol_type = other DNA
tggtcaggcacacagtgtgaa

SEQ ID NO: 8897 - DNA, 19 bp, synthetic construct
  source 1..19: mol_type = other DNA
gggagtgcacagagagcga

SEQ ID NO: 8898 - DNA, 18 bp, synthetic construct
  source 1..18: mol_type = other DNA
gtgccaacctcaacggca

SEQ ID NO: 8899 - DNA, 20 bp, synthetic construct
  source 1..20: mol_type = other DNA
gaggaagtcagcctggagga

SEQ ID NO: 8900 - DNA, 20 bp, synthetic construct
  source 1..20: mol_type = other DNA
gcctaggttagggacggaca

SEQ ID NO: 8901 - DNA, 21 bp, synthetic construct
  source 1..21: mol_type = other DNA
atgtttgtgggccagccagca

SEQ ID NO: 8902 - DNA, 18 bp, synthetic construct
  source 1..18: mol_type = other DNA
actcagctgctgcggcaa

SEQ ID NO: 8903 - DNA, 18 bp, synthetic construct
  source 1..18: mol_type = other DNA
ccgagctcaaatgccgca

SEQ ID NO: 8904 - DNA, 21 bp, synthetic construct
  source 1..21: mol_type = other DNA
agaatgtccaaggggcagaca

SEQ ID NO: 8905 - DNA, 20 bp, synthetic construct
  source 1..20: mol_type = other DNA
ggtccgcagagccgaactga

SEQ ID NO: 8906 - DNA, 22 bp, synthetic construct
  source 1..22: mol_type = other DNA
atgagtgcaaagctgccaacga

SEQ ID NO: 8907 - DNA, 19 bp, synthetic construct
  source 1..19: mol_type = other DNA
gtatccagggctgcaggaa

SEQ ID NO: 8908 - DNA, 23 bp, synthetic construct
  source 1..23: mol_type = other DNA
gccccaggaaacaaagattccca

SEQ ID NO: 8909 - DNA, 18 bp, synthetic construct
  source 1..18: mol_type = other DNA
cggagccagaagtggcaa

SEQ ID NO: 8910 - DNA, 18 bp, synthetic construct
  source 1..18: mol_type = other DNA
gtgaacgagtgcgaggca

SEQ ID NO: 8911 - DNA, 18 bp, synthetic construct
  source 1..18: mol_type = other DNA
agccactgcccccagaga

SEQ ID NO: 8912 - DNA, 18 bp, synthetic construct
  source 1..18: mol_type = other DNA
gcctcgatggcaaacgga

SEQ ID NO: 8913 - DNA, 20 bp, synthetic construct
  source 1..20: mol_type = other DNA
gagtgcctaagacccccaca

SEQ ID NO: 8914 - DNA, 20 bp, synthetic construct
  source 1..20: mol_type = other DNA
ctgccctgaaagctacccaa

SEQ ID NO: 8915 - DNA, 18 bp, synthetic construct
  source 1..18: mol_type = other DNA
ctcccagcgaacggacga

SEQ ID NO: 8916 - DNA, 21 bp, synthetic construct
  source 1..21: mol_type = other DNA
aaagcagacagacgttgcaga

SEQ ID NO: 8917 - DNA, 18 bp, synthetic construct
  source 1..18: mol_type = other DNA
ctgaggtgcacaagccca

SEQ ID NO: 8918 - DNA, 18 bp, synthetic construct
  source 1..18: mol_type = other DNA
ccaccaggaccgcagcaa

SEQ ID NO: 8919 - DNA, 18 bp, synthetic construct
  source 1..18: mol_type = other DNA
aggcgaaccagcagctga

SEQ ID NO: 8920 - DNA, 21 bp, synthetic construct
  source 1..21: mol_type = other DNA
tgctggaggactggactgcta

SEQ ID NO: 8921 - DNA, 20 bp, synthetic construct
  source 1..20: mol_type = other DNA
tgccgcttcaagagggtgca

SEQ ID NO: 8922 - DNA, 20 bp, synthetic construct
  source 1..20: mol_type = other DNA
ctcaggggccatcagtggga

SEQ ID NO: 8923 - DNA, 18 bp, synthetic construct
  source 1..18: mol_type = other DNA
gaaaggccatcgagggga

SEQ ID NO: 8924 - DNA, 18 bp, synthetic construct
  source 1..18: mol_type = other DNA
accccgacgactcagcaa

SEQ ID NO: 8925 - DNA, 19 bp, synthetic construct
  source 1..19: mol_type = other DNA
ccctggacatcagggagca

SEQ ID NO: 8926 - DNA, 17 bp, synthetic construct
  source 1..17: mol_type = other DNA
ccagcggaggcggcaga

SEQ ID NO: 8927 - DNA, 19 bp, synthetic construct
  source 1..19: mol_type = other DNA
ccagaagggagaccaggga

SEQ ID NO: 8928 - DNA, 19 bp, synthetic construct
  source 1..19: mol_type = other DNA
ccctgccccagaagtcaca

SEQ ID NO: 8929 - DNA, 18 bp, synthetic construct
  source 1..18: mol_type = other DNA
acgtcaacggcacggcaa

SEQ ID NO: 8930 - DNA, 21 bp, synthetic construct
  source 1..21: mol_type = other DNA
ctcgctcatcaatggggacga

SEQ ID NO: 8931 - DNA, 20 bp, synthetic construct
  source 1..20: mol_type = other DNA
ctgcagtggactcagaggga

SEQ ID NO: 8932 - DNA, 20 bp, synthetic construct
  source 1..20: mol_type = other DNA
gccgcaactgctccacggaa

SEQ ID NO: 8933 - DNA, 20 bp, synthetic construct
  source 1..20: mol_type = other DNA
ctccactcccgagatccaga

SEQ ID NO: 8934 - DNA, 18 bp, synthetic construct
  source 1..18: mol_type = other DNA
caggttgaagcagcccga

SEQ ID NO: 8935 - DNA, 18 bp, synthetic construct
  source 1..18: mol_type = other DNA
tggccacgggacaacaca

SEQ ID NO: 8936 - DNA, 20 bp, synthetic construct
  source 1..20: mol_type = other DNA
aactggatggcagaagcaga

SEQ ID NO: 8937 - DNA, 20 bp, synthetic construct
  source 1..20: mol_type = other DNA
gatgaccaagagggtggaca

SEQ ID NO: 8938 - DNA, 18 bp, synthetic construct
  source 1..18: mol_type = other DNA
ggtcagcgcagaggagga

SEQ ID NO: 8939 - DNA, 20 bp, synthetic construct
  source 1..20: mol_type = other DNA
attcgccagccaaagtagga

SEQ ID NO: 8940 - DNA, 20 bp, synthetic construct
  source 1..20: mol_type = other DNA
gtgacaggcatcatcaccca

SEQ ID NO: 8941 - DNA, 22 bp, synthetic construct
  source 1..22: mol_type = other DNA
ttgagcaacattggcagcctga

SEQ ID NO: 8942 - DNA, 20 bp, synthetic construct
  source 1..20: mol_type = other DNA
cacaggctgtcagctgcaga

SEQ ID NO: 8943 - DNA, 18 bp, synthetic construct
  source 1..18: mol_type = other DNA
cgaggcctcagagggcaa

SEQ ID NO: 8944 - DNA, 18 bp, synthetic construct
  source 1..18: mol_type = other DNA
gagccacaacacccagca

SEQ ID NO: 8945 - DNA, 20 bp, synthetic construct
  source 1..20: mol_type = other DNA
ccagggaccgtggagacaca

SEQ ID NO: 8946 - DNA, 18 bp, synthetic construct
  source 1..18: mol_type = other DNA
cgggatgtatcagcccca

SEQ ID NO: 8947 - DNA, 18 bp, synthetic construct
  source 1..18: mol_type = other DNA
actgcctgcccgaaccaa

SEQ ID NO: 8948 - DNA, 21 bp, synthetic construct
  source 1..21: mol_type = other DNA
cataggacacgaaatcaccca

SEQ ID NO: 8949 - DNA, 23 bp, synthetic construct
  source 1..23: mol_type = other DNA
ccaaatactgtgcagccgcagaa

SEQ ID NO: 8950 - DNA, 22 bp, synthetic construct
  source 1..22: mol_type = other DNA
ctgagaggctccgagaaatgca

SEQ ID NO: 8951 - DNA, 20 bp, synthetic construct
  source 1..20: mol_type = other DNA
atgtcccaggtgggaaagga

SEQ ID NO: 8952 - DNA, 20 bp, synthetic construct
  source 1..20: mol_type = other DNA
cacgagtgctatcaccccaa

SEQ ID NO: 8953 - DNA, 18 bp, synthetic construct
  source 1..18: mol_type = other DNA
acctggaccaggaaccga

SEQ ID NO: 8954 - DNA, 18 bp, synthetic construct
  source 1..18: mol_type = other DNA
ctagggtggagaccgcca

SEQ ID NO: 8955 - DNA, 18 bp, synthetic construct
  source 1..18: mol_type = other DNA
tgctcaacacggtgcaga

SEQ ID NO: 8956 - DNA, 21 bp, synthetic construct
  source 1..21: mol_type = other DNA
gccaggaaaggacgcgtcgaa

SEQ ID NO: 8957 - DNA, 20 bp, synthetic construct
  source 1..20: mol_type = other DNA
tccactactcccaagggcaa

SEQ ID NO: 8958 - DNA, 20 bp, synthetic construct
  source 1..20: mol_type = other DNA
caggtgaagaacccacctga

SEQ ID NO: 8959 - DNA, 18 bp, synthetic construct
  source 1..18: mol_type = other DNA
acctatcaggcgtgggca

SEQ ID NO: 8960 - DNA, 18 bp, synthetic construct
  source 1..18: mol_type = other DNA
gacgactcccgaacccaa

SEQ ID NO: 8961 - DNA, 20 bp, synthetic construct
  source 1..20: mol_type = other DNA
taccatggcagctgtcccca

SEQ ID NO: 8962 - DNA, 21 bp, synthetic construct
  source 1..21: mol_type = other DNA
tcaaccacgtcatcctggcca

SEQ ID NO: 8963 - DNA, 20 bp, synthetic construct
  source 1..20: mol_type = other DNA
agagccaatgaaaggcccta

SEQ ID NO: 8964 - DNA, 18 bp, synthetic construct
  source 1..18: mol_type = other DNA
ctcatccccaccactgca

SEQ ID NO: 8965 - DNA, 19 bp, synthetic construct
  source 1..19: mol_type = other DNA
ggaaggggccagctagaca

SEQ ID NO: 8966 - DNA, 22 bp, synthetic construct
  source 1..22: mol_type = other DNA
ggaagccaacctcatggacaca

SEQ ID NO: 8967 - DNA, 18 bp, synthetic construct
  source 1..18: mol_type = other DNA
tgagagctgccagcacga

SEQ ID NO: 8968 - DNA, 20 bp, synthetic construct
  source 1..20: mol_type = other DNA
gtccacgacgtggagacaca

SEQ ID NO: 8969 - DNA, 22 bp, synthetic construct
  source 1..22: mol_type = other DNA
caaatggccagcacaatcccca

SEQ ID NO: 8970 - DNA, 18 bp, synthetic construct
  source 1..18: mol_type = other DNA
cttgagcctcacgacgca

SEQ ID NO: 8971 - DNA, 20 bp, synthetic construct
  source 1..20: mol_type = other DNA
ccactgtgcgggagatagca

SEQ ID NO: 8972 - DNA, 18 bp, synthetic construct
  source 1..18: mol_type = other DNA
ccaggcccagaccccaca

SEQ ID NO: 8973 - DNA, 18 bp, synthetic construct
  source 1..18: mol_type = other DNA
ttacccgaacccaggcca

SEQ ID NO: 8974 - DNA, 18 bp, synthetic construct
  source 1..18: mol_type = other DNA
caagaaccgcctgcagca

SEQ ID NO: 8975 - DNA, 20 bp, synthetic construct
  source 1..20: mol_type = other DNA
gaaagcaacgtgccctggca

SEQ ID NO: 8976 - DNA, 18 bp, synthetic construct
  source 1..18: mol_type = other DNA
ggcagagatcgagcggaa

SEQ ID NO: 8977 - DNA, 18 bp, synthetic construct
  source 1..18: mol_type = other DNA
tgccaccctggagaccaa

SEQ ID NO: 8978 - DNA, 18 bp, synthetic construct
  source 1..18: mol_type = other DNA
gcccaagcagctgaagga

SEQ ID NO: 8979 - DNA, 22 bp, synthetic construct
  source 1..22: mol_type = other DNA
aggacacaggcacctatgagga

SEQ ID NO: 8980 - DNA, 22 bp, synthetic construct
  source 1..22: mol_type = other DNA
aaagcggagaaatgccagcaga

SEQ ID NO: 8981 - DNA, 20 bp, synthetic construct
  source 1..20: mol_type = other DNA
ccagtgcactccggtcccaa

SEQ ID NO: 8982 - DNA, 22 bp, synthetic construct
  source 1..22: mol_type = other DNA
agatgagcctcctcctgagaga

SEQ ID NO: 8983 - DNA, 19 bp, synthetic construct
  source 1..19: mol_type = other DNA
gcccctctaactgcagcca

SEQ ID NO: 8984 - DNA, 18 bp, synthetic construct
  source 1..18: mol_type = other DNA
ccaccagtcccaaaggca

SEQ ID NO: 8985 - DNA, 19 bp, synthetic construct
  source 1..19: mol_type = other DNA
ggcagtgagtcagaggcca

SEQ ID NO: 8986 - DNA, 18 bp, synthetic construct
  source 1..18: mol_type = other DNA
gctctccagaacccgcca

SEQ ID NO: 8987 - DNA, 20 bp, synthetic construct
  source 1..20: mol_type = other DNA
gctgacaagcgggacccaga

SEQ ID NO: 8988 - DNA, 21 bp, synthetic construct
  source 1..21: mol_type = other DNA
caccagccttgcacctgaaga

SEQ ID NO: 8989 - DNA, 21 bp, synthetic construct
  source 1..21: mol_type = other DNA
agacaagcccctgagtctcca

SEQ ID NO: 8990 - DNA, 19 bp, synthetic construct
  source 1..19: mol_type = other DNA
gcacatccgggacgtgcga

SEQ ID NO: 8991 - DNA, 18 bp, synthetic construct
  source 1..18: mol_type = other DNA
gccttgcgagacaaccca

SEQ ID NO: 8992 - DNA, 18 bp, synthetic construct
  source 1..18: mol_type = other DNA
ccgagagcagtgccagga

SEQ ID NO: 8993 - DNA, 20 bp, synthetic construct
  source 1..20: mol_type = other DNA
caactggtacctgcagcgga

SEQ ID NO: 8994 - DNA, 18 bp, synthetic construct
  source 1..18: mol_type = other DNA
cctggtcccatggaacca

SEQ ID NO: 8995 - DNA, 22 bp, synthetic construct
  source 1..22: mol_type = other DNA
cagatttgctagaggaaggcga

SEQ ID NO: 8996 - DNA, 19 bp, synthetic construct
  source 1..19: mol_type = other DNA
gcctcctaccaggaagcca

SEQ ID NO: 8997 - DNA, 18 bp, synthetic construct
  source 1..18: mol_type = other DNA
tcaccagcgtgggaagca

SEQ ID NO: 8998 - DNA, 20 bp, synthetic construct
  source 1..20: mol_type = other DNA
accaacgtgacacaggagca

SEQ ID NO: 8999 - DNA, 18 bp, synthetic construct
  source 1..18: mol_type = other DNA
gccactcacttgccccaa

SEQ ID NO: 9000 - DNA, 22 bp, synthetic construct
  source 1..22: mol_type = other DNA
caatccgttcgaaataccccca

SEQ ID NO: 9001 - DNA, 21 bp, synthetic construct
  source 1..21: mol_type = other DNA
ctccaacccagcacatccaga

SEQ ID NO: 9002 - DNA, 18 bp, synthetic construct
  source 1..18: mol_type = other DNA
acacgaaccgtccgccga

SEQ ID NO: 9003 - DNA, 22 bp, synthetic construct
  source 1..22: mol_type = other DNA
ctgggaagagatgatggtggca

SEQ ID NO: 9004 - DNA, 19 bp, synthetic construct
  source 1..19: mol_type = other DNA
cgggacacccagatcagca

SEQ ID NO: 9005 - DNA, 19 bp, synthetic construct
  source 1..19: mol_type = other DNA
ctctgcctcggtctgagga

SEQ ID NO: 9006 - DNA, 18 bp, synthetic construct
  source 1..18: mol_type = other DNA
gctaccagcccgagcaca

SEQ ID NO: 9007 - DNA, 20 bp, synthetic construct
  source 1..20: mol_type = other DNA
gggagcagagcctgagacga

SEQ ID NO: 9008 - DNA, 18 bp, synthetic construct
  source 1..18: mol_type = other DNA
acgccggcaagaagcgaa

SEQ ID NO: 9009 - DNA, 20 bp, synthetic construct
  source 1..20: mol_type = other DNA
aataccagacgacccccaga

SEQ ID NO: 9010 - DNA, 18 bp, synthetic construct
  source 1..18: mol_type = other DNA
caccaatgggtggcacca

SEQ ID NO: 9011 - DNA, 21 bp, synthetic construct
  source 1..21: mol_type = other DNA
tcgctgcaggcacacgacaca

SEQ ID NO: 9012 - DNA, 18 bp, synthetic construct
  source 1..18: mol_type = other DNA
gcacctggccttccagca

SEQ ID NO: 9013 - DNA, 18 bp, synthetic construct
  source 1..18: mol_type = other DNA
gagatccacgggaaggca

SEQ ID NO: 9014 - DNA, 18 bp, synthetic construct
  source 1..18: mol_type = other DNA
gtgctgcgggatcagcaa

SEQ ID NO: 9015 - DNA, 20 bp, synthetic construct
  source 1..20: mol_type = other DNA
cacaggacccaactgcgaga

SEQ ID NO: 9016 - DNA, 18 bp, synthetic construct
  source 1..18: mol_type = other DNA
cccattgatcgacggcca

SEQ ID NO: 9017 - DNA, 19 bp, synthetic construct
  source 1..19: mol_type = other DNA
tgcaacccggtgtacgaga

SEQ ID NO: 9018 - DNA, 19 bp, synthetic construct
  source 1..19: mol_type = other DNA
cctctgactccggaaggca

SEQ ID NO: 9019 - DNA, 22 bp, synthetic construct
  source 1..22: mol_type = other DNA
caaagacaagccaaagtgcgga

SEQ ID NO: 9020 - DNA, 18 bp, synthetic construct
  source 1..18: mol_type = other DNA
cctggaccggggaagtca

SEQ ID NO: 9021 - DNA, 20 bp, synthetic construct
  source 1..20: mol_type = other DNA
ctggacccagagcaaggaca

SEQ ID NO: 9022 - DNA, 18 bp, synthetic construct
  source 1..18: mol_type = other DNA
ggtcaacgccatgcacca

SEQ ID NO: 9023 - DNA, 20 bp, synthetic construct
  source 1..20: mol_type = other DNA
catggcatgaccagtggaga

SEQ ID NO: 9024 - DNA, 19 bp, synthetic construct
  source 1..19: mol_type = other DNA
tgtcagcgctcctaaagca

SEQ ID NO: 9025 - DNA, 21 bp, synthetic construct
  source 1..21: mol_type = other DNA
aggacggagagaagctgggca

SEQ ID NO: 9026 - DNA, 22 bp, synthetic construct
  source 1..22: mol_type = other DNA
agtacaggtccagtgaaaccaa

SEQ ID NO: 9027 - DNA, 20 bp, synthetic construct
  source 1..20: mol_type = other DNA
ctgtcatggaccccaggcga

SEQ ID NO: 9028 - DNA, 19 bp, synthetic construct
  source 1..19: mol_type = other DNA
ggtgggaagcaccgagaga

SEQ ID NO: 9029 - DNA, 18 bp, synthetic construct
  source 1..18: mol_type = other DNA
accgaagaggaggccaca

SEQ ID NO: 9030 - DNA, 18 bp, synthetic construct
  source 1..18: mol_type = other DNA
cgtgcaccgctacggcca

SEQ ID NO: 9031 - DNA, 20 bp, synthetic construct
  source 1..20: mol_type = other DNA
tagcctcacctgcatagcaa

SEQ ID NO: 9032 - DNA, 18 bp, synthetic construct
  source 1..18: mol_type = other DNA
cgacccgcgacgggcaca

SEQ ID NO: 9033 - DNA, 18 bp, synthetic construct
  source 1..18: mol_type = other DNA
actgccagaacggaggga

SEQ ID NO: 9034 - DNA, 20 bp, synthetic construct
  source 1..20: mol_type = other DNA
actgaaggaggcgtccgaga

SEQ ID NO: 9035 - DNA, 19 bp, synthetic construct
  source 1..19: mol_type = other DNA
cgagagccccacatgagga

SEQ ID NO: 9036 - DNA, 18 bp, synthetic construct
  source 1..18: mol_type = other DNA
agacctggccaccaggaa

SEQ ID NO: 9037 - DNA, 21 bp, synthetic construct
  source 1..21: mol_type = other DNA
tcttctacgtcagctccacca

SEQ ID NO: 9038 - DNA, 19 bp, synthetic construct
  source 1..19: mol_type = other DNA
gaggcagaggtgacacgga

SEQ ID NO: 9039 - DNA, 18 bp, synthetic construct
  source 1..18: mol_type = other DNA
tcctccacatcgacccca

SEQ ID NO: 9040 - DNA, 20 bp, synthetic construct
  source 1..20: mol_type = other DNA
caccaagaggaagccgtcca

SEQ ID NO: 9041 - DNA, 20 bp, synthetic construct
  source 1..20: mol_type = other DNA
agctacagcaatgcgggcga

SEQ ID NO: 9042 - DNA, 21 bp, synthetic construct
  source 1..21: mol_type = other DNA
caccttcctctacttggacca

SEQ ID NO: 9043 - DNA, 18 bp, synthetic construct
  source 1..18: mol_type = other DNA
ccatcctcaagacccgca

SEQ ID NO: 9044 - DNA, 18 bp, synthetic construct
  source 1..18: mol_type = other DNA
caaccagcaggaaggcca

SEQ ID NO: 9045 - DNA, 19 bp, synthetic construct
  source 1..19: mol_type = other DNA
gcggacctgagcacacaga

SEQ ID NO: 9046 - DNA, 18 bp, synthetic construct
  source 1..18: mol_type = other DNA
cctggcagctgatgagga

SEQ ID NO: 9047 - DNA, 18 bp, synthetic construct
  source 1..18: mol_type = other DNA
catggatggcctccgcga

SEQ ID NO: 9048 - DNA, 21 bp, synthetic construct
  source 1..21: mol_type = other DNA
tgaaggaccagcctgatgaga

SEQ ID NO: 9049 - DNA, 18 bp, synthetic construct
  source 1..18: mol_type = other DNA
ggaacaccaatgccagca

SEQ ID NO: 9050 - DNA, 18 bp, synthetic construct
  source 1..18: mol_type = other DNA
cgtgggaggccaagagca

SEQ ID NO: 9051 - DNA, 20 bp, synthetic construct
  source 1..20: mol_type = other DNA
cagtaccgccactccgcgca

SEQ ID NO: 9052 - DNA, 20 bp, synthetic construct
  source 1..20: mol_type = other DNA
aacccagtagaggcaccaca

SEQ ID NO: 9053 - DNA, 20 bp, synthetic construct
  source 1..20: mol_type = other DNA
cttcggcagcagtccgcaca

SEQ ID NO: 9054 - DNA, 18 bp, synthetic construct
  source 1..18: mol_type = other DNA
ttcccggaccaggggcca

SEQ ID NO: 9055 - DNA, 20 bp, synthetic construct
  source 1..20: mol_type = other DNA
gggcctgcatcaccacctca

SEQ ID NO: 9056 - DNA, 21 bp, synthetic construct
  source 1..21: mol_type = other DNA
aagggatcagtgagaggcaga

SEQ ID NO: 9057 - DNA, 20 bp, synthetic construct
  source 1..20: mol_type = other DNA
acatagcccaggccacagca

SEQ ID NO: 9058 - DNA, 18 bp, synthetic construct
  source 1..18: mol_type = other DNA
gctgttgcgcacggagga

SEQ ID NO: 9059 - DNA, 18 bp, synthetic construct
  source 1..18: mol_type = other DNA
gctggggcaagaaggcaa

SEQ ID NO: 9060 - DNA, 21 bp, synthetic construct
  source 1..21: mol_type = other DNA
gaagaactcactgcagagcga

SEQ ID NO: 9061 - DNA, 21 bp, synthetic construct
  source 1..21: mol_type = other DNA
agaccaccaccacctttccca

SEQ ID NO: 9062 - DNA, 19 bp, synthetic construct
  source 1..19: mol_type = other DNA
cctgcccctcaactaccca

SEQ ID NO: 9063 - DNA, 20 bp, synthetic construct
  source 1..20: mol_type = other DNA
tccagaggcagtgaccagca

SEQ ID NO: 9064 - DNA, 19 bp, synthetic construct
  source 1..19: mol_type = other DNA
cctcccctcaactccacca

SEQ ID NO: 9065 - DNA, 18 bp, synthetic construct
  source 1..18: mol_type = other DNA
ccagcagcagcatccaca

SEQ ID NO: 9066 - DNA, 21 bp, synthetic construct
  source 1..21: mol_type = other DNA
tgtgaccatctgcagccccaa

SEQ ID NO: 9067 - DNA, 19 bp, synthetic construct
  source 1..19: mol_type = other DNA
cagcgaggagagaggccaa

SEQ ID NO: 9068 - DNA, 20 bp, synthetic construct
  source 1..20: mol_type = other DNA
cacatcccactcacccagga

SEQ ID NO: 9069 - DNA, 20 bp, synthetic construct
  source 1..20: mol_type = other DNA
agtcctgacctggccaagca

SEQ ID NO: 9070 - DNA, 19 bp, synthetic construct
  source 1..19: mol_type = other DNA
cctgaaggaggacccctca

SEQ ID NO: 9071 - DNA, 19 bp, synthetic construct
  source 1..19: mol_type = other DNA
ccacaccgtgaaagagcca

SEQ ID NO: 9072 - DNA, 19 bp, synthetic construct
  source 1..19: mol_type = other DNA
gagacgacccggaaggaga

SEQ ID NO: 9073 - DNA, 18 bp, synthetic construct
  source 1..18: mol_type = other DNA
tgggtaccggatggccaa

SEQ ID NO: 9074 - DNA, 19 bp, synthetic construct
  source 1..19: mol_type = other DNA
tcagctaccaggtggccaa

SEQ ID NO: 9075 - DNA, 18 bp, synthetic construct
  source 1..18: mol_type = other DNA
cccctgatccatgaccga

SEQ ID NO: 9076 - DNA, 18 bp, synthetic construct
  source 1..18: mol_type = other DNA
gactcacctggcccagga

SEQ ID NO: 9077 - DNA, 20 bp, synthetic construct
  source 1..20: mol_type = other DNA
tcctccaagtccctgcccaa

SEQ ID NO: 9078 - DNA, 21 bp, synthetic construct
  source 1..21: mol_type = other DNA
caagtacatccgtgcccccaa

SEQ ID NO: 9079 - DNA, 18 bp, synthetic construct
  source 1..18: mol_type = other DNA
ctggtgaacctgccgaca

SEQ ID NO: 9080 - DNA, 20 bp, synthetic construct
  source 1..20: mol_type = other DNA
cagcacaaggccgccttcca

SEQ ID NO: 9081 - DNA, 18 bp, synthetic construct
  source 1..18: mol_type = other DNA
aaggtgactgcccagcca

SEQ ID NO: 9082 - DNA, 18 bp, synthetic construct
  source 1..18: mol_type = other DNA
tgcggaggcttcagcaga

SEQ ID NO: 9083 - DNA, 18 bp, synthetic construct
  source 1..18: mol_type = other DNA
ggccaaggaactgggcaa

SEQ ID NO: 9084 - DNA, 20 bp, synthetic construct
  source 1..20: mol_type = other DNA
gagccggtgcagtacacaca

SEQ ID NO: 9085 - DNA, 18 bp, synthetic construct
  source 1..18: mol_type = other DNA
ccatccagccgctgcaca

SEQ ID NO: 9086 - DNA, 18 bp, synthetic construct
  source 1..18: mol_type = other DNA
ggtgatcagcgccacaca

SEQ ID NO: 9087 - DNA, 20 bp, synthetic construct
  source 1..20: mol_type = other DNA
caggaccctgagctatcgga

SEQ ID NO: 9088 - DNA, 19 bp, synthetic construct
  source 1..19: mol_type = other DNA
ggcaagaggtgggcagaca

SEQ ID NO: 9089 - DNA, 18 bp, synthetic construct
  source 1..18: mol_type = other DNA
aggcagactgcggcctca

SEQ ID NO: 9090 - DNA, 21 bp, synthetic construct
  source 1..21: mol_type = other DNA
caaagtccaggaagccaggaa

SEQ ID NO: 9091 - DNA, 19 bp, synthetic construct
  source 1..19: mol_type = other DNA
gaggtccagctgtccagca

SEQ ID NO: 9092 - DNA, 22 bp, synthetic construct
  source 1..22: mol_type = other DNA
atcagaaactcagccctggaca

SEQ ID NO: 9093 - DNA, 21 bp, synthetic construct
  source 1..21: mol_type = other DNA
cagaatctcggcgaaggagca

SEQ ID NO: 9094 - DNA, 18 bp, synthetic construct
  source 1..18: mol_type = other DNA
tgacggtcacaggcacca

SEQ ID NO: 9095 - DNA, 20 bp, synthetic construct
  source 1..20: mol_type = other DNA
gccccgatgatcaccccaga

SEQ ID NO: 9096 - DNA, 20 bp, synthetic construct
  source 1..20: mol_type = other DNA
aggctcaactcactggccca

SEQ ID NO: 9097 - DNA, 19 bp, synthetic construct
  source 1..19: mol_type = other DNA
ggagggacccaagtgacca

SEQ ID NO: 9098 - DNA, 18 bp, synthetic construct
  source 1..18: mol_type = other DNA
ccaaactgccatgcccca

SEQ ID NO: 9099 - DNA, 18 bp, synthetic construct
  source 1..18: mol_type = other DNA
cccacgatgccaacgaga

SEQ ID NO: 9100 - DNA, 20 bp, synthetic construct
  source 1..20: mol_type = other DNA
tgaaagccaccgaggagcca

SEQ ID NO: 9101 - DNA, 18 bp, synthetic construct
  source 1..18: mol_type = other DNA
gcgagctccggaaagaga

SEQ ID NO: 9102 - DNA, 20 bp, synthetic construct
  source 1..20: mol_type = other DNA
gggaatctccgaccccgaca

SEQ ID NO: 9103 - DNA, 20 bp, synthetic construct
  source 1..20: mol_type = other DNA
tctgccactgaatctggcta

SEQ ID NO: 9104 - DNA, 21 bp, synthetic construct
  source 1..21: mol_type = other DNA
catgggtaccacactggcaga

SEQ ID NO: 9105 - DNA, 23 bp, synthetic construct
  source 1..23: mol_type = other DNA
gcaacacgaagcttccagaacca

SEQ ID NO: 9106 - DNA, 18 bp, synthetic construct
  source 1..18: mol_type = other DNA
gccgagcagtcaaagcca

SEQ ID NO: 9107 - DNA, 21 bp, synthetic construct
  source 1..21: mol_type = other DNA
gcatatgcctcccagagagga

SEQ ID NO: 9108 - DNA, 18 bp, synthetic construct
  source 1..18: mol_type = other DNA
aggccgacctggagcaca

SEQ ID NO: 9109 - DNA, 20 bp, synthetic construct
  source 1..20: mol_type = other DNA
gtgaaccatccagatgccaa

SEQ ID NO: 9110 - DNA, 20 bp, synthetic construct
  source 1..20: mol_type = other DNA
cagcaaaccaccttcacgga

SEQ ID NO: 9111 - DNA, 20 bp, synthetic construct
  source 1..20: mol_type = other DNA
tgcacagggccgcaagcgca

SEQ ID NO: 9112 - DNA, 20 bp, synthetic construct
  source 1..20: mol_type = other DNA
cgcgctggccaacctcaaga

SEQ ID NO: 9113 - DNA, 25 bp, synthetic construct
  source 1..25: mol_type = other DNA
aggagctagggaaagaaaacctgga

SEQ ID NO: 9114 - DNA, 20 bp, synthetic construct
  source 1..20: mol_type = other DNA
caatgccacaccagagcaga

SEQ ID NO: 9115 - DNA, 18 bp, synthetic construct
  source 1..18: mol_type = other DNA
cctggagaacgtgccaca

SEQ ID NO: 9116 - DNA, 20 bp, synthetic construct
  source 1..20: mol_type = other DNA
atctccaactacggcaccca

SEQ ID NO: 9117 - DNA, 19 bp, synthetic construct
  source 1..19: mol_type = other DNA
ggaggtgctacaggggcaa

SEQ ID NO: 9118 - DNA, 20 bp, synthetic construct
  source 1..20: mol_type = other DNA
cagtcagtggaacaagccga

SEQ ID NO: 9119 - DNA, 20 bp, synthetic construct
  source 1..20: mol_type = other DNA
ctcggtatgaactgcgggaa

SEQ ID NO: 9120 - DNA, 20 bp, synthetic construct
  source 1..20: mol_type = other DNA
gaccaaagaggcgttggaga

SEQ ID NO: 9121 - DNA, 19 bp, synthetic construct
  source 1..19: mol_type = other DNA
gaggaggtgactcagcgca

SEQ ID NO: 9122 - DNA, 18 bp, synthetic construct
  source 1..18: mol_type = other DNA
gccgaagcgagaaggcaa

SEQ ID NO: 9123 - DNA, 20 bp, synthetic construct
  source 1..20: mol_type = other DNA
gtgagccctcctgctaagca

SEQ ID NO: 9124 - DNA, 22 bp, synthetic construct
  source 1..22: mol_type = other DNA
ggaatcagcccaacgatcaaga

SEQ ID NO: 9125 - DNA, 18 bp, synthetic construct
  source 1..18: mol_type = other DNA
ccaacacagtgcccgaca

SEQ ID NO: 9126 - DNA, 20 bp, synthetic construct
  source 1..20: mol_type = other DNA
cacaggcctggtgctcaaga

SEQ ID NO: 9127 - DNA, 21 bp, synthetic construct
  source 1..21: mol_type = other DNA
cagcaaaaagcccacccagga

SEQ ID NO: 9128 - DNA, 18 bp, synthetic construct
  source 1..18: mol_type = other DNA
gccacagcaacaccagca

SEQ ID NO: 9129 - DNA, 19 bp, synthetic construct
  source 1..19: mol_type = other DNA
gaggagacggaccacctca

SEQ ID NO: 9130 - DNA, 18 bp, synthetic construct
  source 1..18: mol_type = other DNA
gggccagtacaccgtcca

SEQ ID NO: 9131 - DNA, 20 bp, synthetic construct
  source 1..20: mol_type = other DNA
ctggcagaaggaggcagaga

SEQ ID NO: 9132 - DNA, 18 bp, synthetic construct
  source 1..18: mol_type = other DNA
gcgcaccggagaggacga

SEQ ID NO: 9133 - DNA, 19 bp, synthetic construct
  source 1..19: mol_type = other DNA
cccctcagcaccaagcaga

SEQ ID NO: 9134 - DNA, 18 bp, synthetic construct
  source 1..18: mol_type = other DNA
agtcagggaaccacccca

SEQ ID NO: 9135 - DNA, 20 bp, synthetic construct
  source 1..20: mol_type = other DNA
aagtcacagcggagagcaga

SEQ ID NO: 9136 - DNA, 18 bp, synthetic construct
  source 1..18: mol_type = other DNA
caccagctggccagacca

SEQ ID NO: 9137 - DNA, 19 bp, synthetic construct
  source 1..19: mol_type = other DNA
gggagcatggagaggagca

SEQ ID NO: 9138 - DNA, 18 bp, synthetic construct
  source 1..18: mol_type = other DNA
agaccctgccacgagcaa

SEQ ID NO: 9139 - DNA, 18 bp, synthetic construct
  source 1..18: mol_type = other DNA
gatcccaagaggcccgaa

SEQ ID NO: 9140 - DNA, 20 bp, synthetic construct
  source 1..20: mol_type = other DNA
cagcgaatggcacagaagga

SEQ ID NO: 9141 - DNA, 20 bp, synthetic construct
  source 1..20: mol_type = other DNA
caagagagaagccggagcca

SEQ ID NO: 9142 - DNA, 18 bp, synthetic construct
  source 1..18: mol_type = other DNA
cgatggggagagcagcaa

SEQ ID NO: 9143 - DNA, 20 bp, synthetic construct
  source 1..20: mol_type = other DNA
ggccagaggacaacaagcca

SEQ ID NO: 9144 - DNA, 20 bp, synthetic construct
  source 1..20: mol_type = other DNA
cagttcacagactggccgga

SEQ ID NO: 9145 - DNA, 19 bp, synthetic construct
  source 1..19: mol_type = other DNA
ggaggagtgacggcaggaa

SEQ ID NO: 9146 - DNA, 18 bp, synthetic construct
  source 1..18: mol_type = other DNA
ggccgacgccgtactgga

SEQ ID NO: 9147 - DNA, 18 bp, synthetic construct
  source 1..18: mol_type = other DNA
agcaacccagagcccaca

SEQ ID NO: 9148 - DNA, 20 bp, synthetic construct
  source 1..20: mol_type = other DNA
ctgtgacgcctcaggacaga

SEQ ID NO: 9149 - DNA, 18 bp, synthetic construct
  source 1..18: mol_type = other DNA
cgctagccacttcgagca

SEQ ID NO: 9150 - DNA, 21 bp, synthetic construct
  source 1..21: mol_type = other DNA
ccaggggtgaggaagaggaga

SEQ ID NO: 9151 - DNA, 19 bp, synthetic construct
  source 1..19: mol_type = other DNA
tccaggaagcacaagccta

SEQ ID NO: 9152 - DNA, 18 bp, synthetic construct
  source 1..18: mol_type = other DNA
ccaccctcagtccctgca

SEQ ID NO: 9153 - DNA, 18 bp, synthetic construct
  source 1..18: mol_type = other DNA
caccggcatccacaggca

SEQ ID NO: 9154 - DNA, 18 bp, synthetic construct
  source 1..18: mol_type = other DNA
cccagcatgtgttccgca

SEQ ID NO: 9155 - DNA, 20 bp, synthetic construct
  source 1..20: mol_type = other DNA
tatcaactctgacagcccga

SEQ ID NO: 9156 - DNA, 21 bp, synthetic construct
  source 1..21: mol_type = other DNA
aagtccagagagagcagacca

SEQ ID NO: 9157 - DNA, 18 bp, synthetic construct
  source 1..18: mol_type = other DNA
tcatcccagcggtgggaa

SEQ ID NO: 9158 - DNA, 20 bp, synthetic construct
  source 1..20: mol_type = other DNA
ctgcttccctgaggaggaga

SEQ ID NO: 9159 - DNA, 20 bp, synthetic construct
  source 1..20: mol_type = other DNA
gtgccagagcgtcacctcca

SEQ ID NO: 9160 - DNA, 18 bp, synthetic construct
  source 1..18: mol_type = other DNA
tcacaggcaacctcgcca

SEQ ID NO: 9161 - DNA, 18 bp, synthetic construct
  source 1..18: mol_type = other DNA
ctgacagcaaacccccga

SEQ ID NO: 9162 - DNA, 18 bp, synthetic construct
  source 1..18: mol_type = other DNA
cttcatccgcgcacggaa

SEQ ID NO: 9163 - DNA, 19 bp, synthetic construct
  source 1..19: mol_type = other DNA
tatcggaatcccgctcaca

SEQ ID NO: 9164 - DNA, 18 bp, synthetic construct
  source 1..18: mol_type = other DNA
aagatcagccctcggcga

SEQ ID NO: 9165 - DNA, 22 bp, synthetic construct
  source 1..22: mol_type = other DNA
tacgggaacatcaccttgccca

SEQ ID NO: 9166 - DNA, 18 bp, synthetic construct
  source 1..18: mol_type = other DNA
ggatacggatgcgccaga

SEQ ID NO: 9167 - DNA, 20 bp, synthetic construct
  source 1..20: mol_type = other DNA
ctgaagactgcccacccaga

SEQ ID NO: 9168 - DNA, 21 bp, synthetic construct
  source 1..21: mol_type = other DNA
tgacacacagaacgccccaga

SEQ ID NO: 9169 - DNA, 19 bp, synthetic construct
  source 1..19: mol_type = other DNA
ggagcctgtgtagccagca

SEQ ID NO: 9170 - DNA, 18 bp, synthetic construct
  source 1..18: mol_type = other DNA
cagccgcagaagccagga

SEQ ID NO: 9171 - DNA, 21 bp, synthetic construct
  source 1..21: mol_type = other DNA
gaggagactgtgctggcaaca

SEQ ID NO: 9172 - DNA, 18 bp, synthetic construct
  source 1..18: mol_type = other DNA
cacgacggcaagcaggca

SEQ ID NO: 9173 - DNA, 20 bp, synthetic construct
  source 1..20: mol_type = other DNA
aggccaggctgttcacgcaa

SEQ ID NO: 9174 - DNA, 21 bp, synthetic construct
  source 1..21: mol_type = other DNA
gtccacagtccacggtacaca

SEQ ID NO: 9175 - DNA, 21 bp, synthetic construct
  source 1..21: mol_type = other DNA
gccagactccctacgtggaca

SEQ ID NO: 9176 - DNA, 22 bp, synthetic construct
  source 1..22: mol_type = other DNA
ctacacgcagtcagaaacggaa

SEQ ID NO: 9177 - DNA, 21 bp, synthetic construct
  source 1..21: mol_type = other DNA
ccgtctacagggatgacctga

SEQ ID NO: 9178 - DNA, 18 bp, synthetic construct
  source 1..18: mol_type = other DNA
actccggcaccaacccca

SEQ ID NO: 9179 - DNA, 20 bp, synthetic construct
  source 1..20: mol_type = other DNA
ctgcctctctacgccaagca

SEQ ID NO: 9180 - DNA, 20 bp, synthetic construct
  source 1..20: mol_type = other DNA
gtccatggcactgctgcgga

SEQ ID NO: 9181 - DNA, 19 bp, synthetic construct
  source 1..19: mol_type = other DNA
cgtcgaggctcactccgga

SEQ ID NO: 9182 - DNA, 18 bp, synthetic construct
  source 1..18: mol_type = other DNA
ctgcggggaccacctcga

SEQ ID NO: 9183 - DNA, 20 bp, synthetic construct
  source 1..20: mol_type = other DNA
aatggctcaggtccgcacga

SEQ ID NO: 9184 - DNA, 18 bp, synthetic construct
  source 1..18: mol_type = other DNA
cggtcacgggaatcccca

SEQ ID NO: 9185 - DNA, 18 bp, synthetic construct
  source 1..18: mol_type = other DNA
cgggacctccaggggcga

SEQ ID NO: 9186 - DNA, 20 bp, synthetic construct
  source 1..20: mol_type = other DNA
tgccaccctcaacgtcctca

SEQ ID NO: 9187 - DNA, 18 bp, synthetic construct
  source 1..18: mol_type = other DNA
cggcgagatggctgggca

SEQ ID NO: 9188 - DNA, 18 bp, synthetic construct
  source 1..18: mol_type = other DNA
ggaaccgcctcaagacga

SEQ ID NO: 9189 - DNA, 20 bp, synthetic construct
  source 1..20: mol_type = other DNA
tgctgaggatggagcctcca

SEQ ID NO: 9190 - DNA, 22 bp, synthetic construct
  source 1..22: mol_type = other DNA
atgtaccttgacaacagctcca

SEQ ID NO: 9191 - DNA, 21 bp, synthetic construct
  source 1..21: mol_type = other DNA
tcagctcaagtggaagcccca

SEQ ID NO: 9192 - DNA, 21 bp, synthetic construct
  source 1..21: mol_type = other DNA
ggtacagctctgccatcgcca

SEQ ID NO: 9193 - DNA, 19 bp, synthetic construct
  source 1..19: mol_type = other DNA
tccatttgacacaccccca

SEQ ID NO: 9194 - DNA, 18 bp, synthetic construct
  source 1..18: mol_type = other DNA
agctgaagccagcccaga

SEQ ID NO: 9195 - DNA, 18 bp, synthetic construct
  source 1..18: mol_type = other DNA
gggacaacgagaagccca

SEQ ID NO: 9196 - DNA, 20 bp, synthetic construct
  source 1..20: mol_type = other DNA
caaggaggactgcgtggaga

SEQ ID NO: 9197 - DNA, 19 bp, synthetic construct
  source 1..19: mol_type = other DNA
ctgcacaaacagcatgcca

SEQ ID NO: 9198 - DNA, 18 bp, synthetic construct
  source 1..18: mol_type = other DNA
tcccatggcagccagcaa

SEQ ID NO: 9199 - DNA, 18 bp, synthetic construct
  source 1..18: mol_type = other DNA
ggcaattccagaggcgaa

SEQ ID NO: 9200 - DNA, 18 bp, synthetic construct
  source 1..18: mol_type = other DNA
acggacaaatggtcccca

SEQ ID NO: 9201 - DNA, 18 bp, synthetic construct
  source 1..18: mol_type = other DNA
tggacagccaggaccaga

SEQ ID NO: 9202 - DNA, 20 bp, synthetic construct
  source 1..20: mol_type = other DNA
gtagccagctactgcccaga

SEQ ID NO: 9203 - DNA, 19 bp, synthetic construct
  source 1..19: mol_type = other DNA
ggccctgtcctgaaccaga

SEQ ID NO: 9204 - DNA, 18 bp, synthetic construct
  source 1..18: mol_type = other DNA
gcgtgttgaaggccgaga

SEQ ID NO: 9205 - DNA, 18 bp, synthetic construct
  source 1..18: mol_type = other DNA
ggacacctccaccgagca

SEQ ID NO: 9206 - DNA, 18 bp, synthetic construct
  source 1..18: mol_type = other DNA
gcctgagcacagtggcaa

SEQ ID NO: 9207 - DNA, 18 bp, synthetic construct
  source 1..18: mol_type = other DNA
gcaacaaccccgaaccca

SEQ ID NO: 9208 - DNA, 21 bp, synthetic construct
  source 1..21: mol_type = other DNA
ggcttaggggactgcacagga

SEQ ID NO: 9209 - DNA, 21 bp, synthetic construct
  source 1..21: mol_type = other DNA
acaaggagaacgtggagcaga

SEQ ID NO: 9210 - DNA, 20 bp, synthetic construct
  source 1..20: mol_type = other DNA
gaggacttccacgtggacca

SEQ ID NO: 9211 - DNA, 20 bp, synthetic construct
  source 1..20: mol_type = other DNA
gaggaagccttcaccagcaa

SEQ ID NO: 9212 - DNA, 20 bp, synthetic construct
  source 1..20: mol_type = other DNA
tcagcgcacacctgtacaga

SEQ ID NO: 9213 - DNA, 18 bp, synthetic construct
  source 1..18: mol_type = other DNA
gtcgacaagtgcccccaa

SEQ ID NO: 9214 - DNA, 18 bp, synthetic construct
  source 1..18: mol_type = other DNA
aagctcgccaggtccaca

SEQ ID NO: 9215 - DNA, 21 bp, synthetic construct
  source 1..21: mol_type = other DNA
cagcaccagacagtgctggaa

SEQ ID NO: 9216 - DNA, 20 bp, synthetic construct
  source 1..20: mol_type = other DNA
caaaatgtagccgtggccaa

SEQ ID NO: 9217 - DNA, 18 bp, synthetic construct
  source 1..18: mol_type = other DNA
aggtcccgaggaacgaca

SEQ ID NO: 9218 - DNA, 18 bp, synthetic construct
  source 1..18: mol_type = other DNA
agaatggctgccgcgaga

SEQ ID NO: 9219 - DNA, 18 bp, synthetic construct
  source 1..18: mol_type = other DNA
ttccaggccaagcccgca

SEQ ID NO: 9220 - DNA, 19 bp, synthetic construct
  source 1..19: mol_type = other DNA
gcacacaggctggtggaca

SEQ ID NO: 9221 - DNA, 21 bp, synthetic construct
  source 1..21: mol_type = other DNA
agaaggctgttgagagaagga

SEQ ID NO: 9222 - DNA, 20 bp, synthetic construct
  source 1..20: mol_type = other DNA
gaagccacctgcaggacaga

SEQ ID NO: 9223 - DNA, 18 bp, synthetic construct
  source 1..18: mol_type = other DNA
atgtgctgccgacgggaa

SEQ ID NO: 9224 - DNA, 21 bp, synthetic construct
  source 1..21: mol_type = other DNA
tgagagccagtgaagatggca

SEQ ID NO: 9225 - DNA, 19 bp, synthetic construct
  source 1..19: mol_type = other DNA
gcagagtcgagggagcaca

SEQ ID NO: 9226 - DNA, 20 bp, synthetic construct
  source 1..20: mol_type = other DNA
ctggcgtctacacctgccaa

SEQ ID NO: 9227 - DNA, 18 bp, synthetic construct
  source 1..18: mol_type = other DNA
catcctgcagctgccaga

SEQ ID NO: 9228 - DNA, 18 bp, synthetic construct
  source 1..18: mol_type = other DNA
ggaagggggattcaggga

SEQ ID NO: 9229 - DNA, 20 bp, synthetic construct
  source 1..20: mol_type = other DNA
ctggaggggaacagcagcca

SEQ ID NO: 9230 - DNA, 18 bp, synthetic construct
  source 1..18: mol_type = other DNA
ccaggaccacagcaccaa

SEQ ID NO: 9231 - DNA, 21 bp, synthetic construct
  source 1..21: mol_type = other DNA
agccagactgactctgaccca

SEQ ID NO: 9232 - DNA, 19 bp, synthetic construct
  source 1..19: mol_type = other DNA
ggggagggacctggtggga

SEQ ID NO: 9233 - DNA, 20 bp, synthetic construct
  source 1..20: mol_type = other DNA
ggcccaacatcctcatccca

SEQ ID NO: 9234 - DNA, 18 bp, synthetic construct
  source 1..18: mol_type = other DNA
agcccacccgaaggagca

SEQ ID NO: 9235 - DNA, 20 bp, synthetic construct
  source 1..20: mol_type = other DNA
ggagactcacaggagtggca

SEQ ID NO: 9236 - DNA, 18 bp, synthetic construct
  source 1..18: mol_type = other DNA
gcatccgcagcacagcca

SEQ ID NO: 9237 - DNA, 18 bp, synthetic construct
  source 1..18: mol_type = other DNA
aggagaacgggacctgca

SEQ ID NO: 9238 - DNA, 22 bp, synthetic construct
  source 1..22: mol_type = other DNA
atgggaggccttgggaaacaca

SEQ ID NO: 9239 - DNA, 19 bp, synthetic construct
  source 1..19: mol_type = other DNA
aagcagccaatgagtccca

SEQ ID NO: 9240 - DNA, 18 bp, synthetic construct
  source 1..18: mol_type = other DNA
ggcgacgggagacaacca

SEQ ID NO: 9241 - DNA, 21 bp, synthetic construct
  source 1..21: mol_type = other DNA
agagcgagacagagaggcaca

SEQ ID NO: 9242 - DNA, 19 bp, synthetic construct
  source 1..19: mol_type = other DNA
gacaccgtccgcgacacca

SEQ ID NO: 9243 - DNA, 18 bp, synthetic construct
  source 1..18: mol_type = other DNA
ggaccctgtacagccgca

SEQ ID NO: 9244 - DNA, 22 bp, synthetic construct
  source 1..22: mol_type = other DNA
gataatccatggacagggggca

SEQ ID NO: 9245 - DNA, 22 bp, synthetic construct
  source 1..22: mol_type = other DNA
caaattcaactgggacccggaa

SEQ ID NO: 9246 - DNA, 20 bp, synthetic construct
  source 1..20: mol_type = other DNA
aagcacaagactcgggagga

SEQ ID NO: 9247 - DNA, 18 bp, synthetic construct
  source 1..18: mol_type = other DNA
gacaagcgcgtcaccaga

SEQ ID NO: 9248 - DNA, 21 bp, synthetic construct
  source 1..21: mol_type = other DNA
atggacaaggtcgggaggaga

SEQ ID NO: 9249 - DNA, 18 bp, synthetic construct
  source 1..18: mol_type = other DNA
gccagctcattgggacca

SEQ ID NO: 9250 - DNA, 20 bp, synthetic construct
  source 1..20: mol_type = other DNA
ggaaccggtgggaagacaca

SEQ ID NO: 9251 - DNA, 18 bp, synthetic construct
  source 1..18: mol_type = other DNA
cagagaccgcaggagcca

SEQ ID NO: 9252 - DNA, 19 bp, synthetic construct
  source 1..19: mol_type = other DNA
gctccaccagtcctgggaa

SEQ ID NO: 9253 - DNA, 18 bp, synthetic construct
  source 1..18: mol_type = other DNA
gggtgatctgggccgaca

SEQ ID NO: 9254 - DNA, 20 bp, synthetic construct
  source 1..20: mol_type = other DNA
ctccacgagcatcttcgaga

SEQ ID NO: 9255 - DNA, 18 bp, synthetic construct
  source 1..18: mol_type = other DNA
aaattgggccaggcccga

SEQ ID NO: 9256 - DNA, 18 bp, synthetic construct
  source 1..18: mol_type = other DNA
cctggggacgctcaacca

SEQ ID NO: 9257 - DNA, 18 bp, synthetic construct
  source 1..18: mol_type = other DNA
cgtggtggtgagtggcaa

SEQ ID NO: 9258 - DNA, 18 bp, synthetic construct
  source 1..18: mol_type = other DNA
tgacaacgtgcagtccga

SEQ ID NO: 9259 - DNA, 18 bp, synthetic construct
  source 1..18: mol_type = other DNA
ccagtggcaccacaagca

SEQ ID NO: 9260 - DNA, 18 bp, synthetic construct
  source 1..18: mol_type = other DNA
gaagctgcagaacgggga

SEQ ID NO: 9261 - DNA, 20 bp, synthetic construct
  source 1..20: mol_type = other DNA
cagcgctactctcgggagga

SEQ ID NO: 9262 - DNA, 18 bp, synthetic construct
  source 1..18: mol_type = other DNA
ctgctcagcacccagcca

SEQ ID NO: 9263 - DNA, 20 bp, synthetic construct
  source 1..20: mol_type = other DNA
taggtacggtggcaaaagga

SEQ ID NO: 9264 - DNA, 20 bp, synthetic construct
  source 1..20: mol_type = other DNA
cgggcccagggttatgccaa

SEQ ID NO: 9265 - DNA, 18 bp, synthetic construct
  source 1..18: mol_type = other DNA
tcacgtcgctcagcggca

SEQ ID NO: 9266 - DNA, 21 bp, synthetic construct
  source 1..21: mol_type = other DNA
tgaacctccaaaccccagcaa

SEQ ID NO: 9267 - DNA, 18 bp, synthetic construct
  source 1..18: mol_type = other DNA
cctggaatcgaccaccca

SEQ ID NO: 9268 - DNA, 18 bp, synthetic construct
  source 1..18: mol_type = other DNA
ccctggccatcatcggca

SEQ ID NO: 9269 - DNA, 18 bp, synthetic construct
  source 1..18: mol_type = other DNA
ccatctaccacgcagcca

SEQ ID NO: 9270 - DNA, 21 bp, synthetic construct
  source 1..21: mol_type = other DNA
gatctcccgaagccacacaga

SEQ ID NO: 9271 - DNA, 20 bp, synthetic construct
  source 1..20: mol_type = other DNA
gatgctgctccggaggcaga

SEQ ID NO: 9272 - DNA, 19 bp, synthetic construct
  source 1..19: mol_type = other DNA
ccccgcatagctaccacca

SEQ ID NO: 9273 - DNA, 18 bp, synthetic construct
  source 1..18: mol_type = other DNA
cccgaaggtcaccaagca

SEQ ID NO: 9274 - DNA, 18 bp, synthetic construct
  source 1..18: mol_type = other DNA
tcggctgggtgatcgaca

SEQ ID NO: 9275 - DNA, 21 bp, synthetic construct
  source 1..21: mol_type = other DNA
tccgaagagaagctccggtca

SEQ ID NO: 9276 - DNA, 18 bp, synthetic construct
  source 1..18: mol_type = other DNA
tggaccgctgaggagcaa

SEQ ID NO: 9277 - DNA, 20 bp, synthetic construct
  source 1..20: mol_type = other DNA
caggtggccactgacaagga

SEQ ID NO: 9278 - DNA, 22 bp, synthetic construct
  source 1..22: mol_type = other DNA
gctagaaaagcaggccacacca

SEQ ID NO: 9279 - DNA, 22 bp, synthetic construct
  source 1..22: mol_type = other DNA
ggcatccaaatgcaatgccaca

SEQ ID NO: 9280 - DNA, 19 bp, synthetic construct
  source 1..19: mol_type = other DNA
tccggagcacccttagcta

SEQ ID NO: 9281 - DNA, 18 bp, synthetic construct
  source 1..18: mol_type = other DNA
cccccgggcatctcgaca

SEQ ID NO: 9282 - DNA, 21 bp, synthetic construct
  source 1..21: mol_type = other DNA
gagcagaataccgaaggcaga

SEQ ID NO: 9283 - DNA, 18 bp, synthetic construct
  source 1..18: mol_type = other DNA
ggccttctctaagcggca

SEQ ID NO: 9284 - DNA, 18 bp, synthetic construct
  source 1..18: mol_type = other DNA
gggtacatcgcctgcaca

SEQ ID NO: 9285 - DNA, 20 bp, synthetic construct
  source 1..20: mol_type = other DNA
ctcgagtaccagctgaccga

SEQ ID NO: 9286 - DNA, 19 bp, synthetic construct
  source 1..19: mol_type = other DNA
cctcagaaccgacgccaga

SEQ ID NO: 9287 - DNA, 22 bp, synthetic construct
  source 1..22: mol_type = other DNA
accctgaaccacccaagcaaca

SEQ ID NO: 9288 - DNA, 21 bp, synthetic construct
  source 1..21: mol_type = other DNA
gaaccttacactgaccgggga

SEQ ID NO: 9289 - DNA, 20 bp, synthetic construct
  source 1..20: mol_type = other DNA
cagtgggtcccagatggaga

SEQ ID NO: 9290 - DNA, 18 bp, synthetic construct
  source 1..18: mol_type = other DNA
agccgaatgccgtaggca

SEQ ID NO: 9291 - DNA, 18 bp, synthetic construct
  source 1..18: mol_type = other DNA
gaggtggaccgcacggaa

SEQ ID NO: 9292 - DNA, 18 bp, synthetic construct
  source 1..18: mol_type = other DNA
acatgaacggctcgccca

SEQ ID NO: 9293 - DNA, 18 bp, synthetic construct
  source 1..18: mol_type = other DNA
aacactcctggccaccca

SEQ ID NO: 9294 - DNA, 21 bp, synthetic construct
  source 1..21: mol_type = other DNA
ggccaacgagatgatgccgga

SEQ ID NO: 9295 - DNA, 20 bp, synthetic construct
  source 1..20: mol_type = other DNA
gtctccaacgacctccacca

SEQ ID NO: 9296 - DNA, 21 bp, synthetic construct
  source 1..21: mol_type = other DNA
gcacaaccaaggactactgca

SEQ ID NO: 9297 - DNA, 21 bp, synthetic construct
  source 1..21: mol_type = other DNA
catcacgcccttcctgaccaa

SEQ ID NO: 9298 - DNA, 18 bp, synthetic construct
  source 1..18: mol_type = other DNA
agcatggtggccgcacca

SEQ ID NO: 9299 - DNA, 18 bp, synthetic construct
  source 1..18: mol_type = other DNA
cccatgggcggacgacca

SEQ ID NO: 9300 - DNA, 19 bp, synthetic construct
  source 1..19: mol_type = other DNA
gcacctggacagggaggaa

SEQ ID NO: 9301 - DNA, 18 bp, synthetic construct
  source 1..18: mol_type = other DNA
ggaccccagactccgtca

SEQ ID NO: 9302 - DNA, 18 bp, synthetic construct
  source 1..18: mol_type = other DNA
caactggctgcaagggca

SEQ ID NO: 9303 - DNA, 20 bp, synthetic construct
  source 1..20: mol_type = other DNA
caaactgctgagcctgccaa

SEQ ID NO: 9304 - DNA, 18 bp, synthetic construct
  source 1..18: mol_type = other DNA
cctcccatccaagcgcaa

SEQ ID NO: 9305 - DNA, 18 bp, synthetic construct
  source 1..18: mol_type = other DNA
ggcctatggcatcgacca

SEQ ID NO: 9306 - DNA, 22 bp, synthetic construct
  source 1..22: mol_type = other DNA
ggtacaacgtgtcaaccaacga

SEQ ID NO: 9307 - DNA, 18 bp, synthetic construct
  source 1..18: mol_type = other DNA
gaccgtggaaagggacca

SEQ ID NO: 9308 - DNA, 20 bp, synthetic construct
  source 1..20: mol_type = other DNA
gaggcacaaaataccgtcga

SEQ ID NO: 9309 - DNA, 21 bp, synthetic construct
  source 1..21: mol_type = other DNA
ctgccctcaacatagacccca

SEQ ID NO: 9310 - DNA, 19 bp, synthetic construct
  source 1..19: mol_type = other DNA
cccttgcctgaggacagga

SEQ ID NO: 9311 - DNA, 20 bp, synthetic construct
  source 1..20: mol_type = other DNA
gtgcaccctccccatgctga

SEQ ID NO: 9312 - DNA, 20 bp, synthetic construct
  source 1..20: mol_type = other DNA
tgggcagcggtgaacaggaa

SEQ ID NO: 9313 - DNA, 19 bp, synthetic construct
  source 1..19: mol_type = other DNA
ccacgcctcagactgagga

SEQ ID NO: 9314 - DNA, 18 bp, synthetic construct
  source 1..18: mol_type = other DNA
gctgagcttcaccgagca

SEQ ID NO: 9315 - DNA, 18 bp, synthetic construct
  source 1..18: mol_type = other DNA
aagcgagggcatgaccca

SEQ ID NO: 9316 - DNA, 19 bp, synthetic construct
  source 1..19: mol_type = other DNA
cgtgacagggacgggcgaa

SEQ ID NO: 9317 - DNA, 18 bp, synthetic construct
  source 1..18: mol_type = other DNA
gaccggggtcaaacgcaa

SEQ ID NO: 9318 - DNA, 20 bp, synthetic construct
  source 1..20: mol_type = other DNA
cggtatcgtcccagacccaa

SEQ ID NO: 9319 - DNA, 19 bp, synthetic construct
  source 1..19: mol_type = other DNA
gcagcttggcagtgaccaa

SEQ ID NO: 9320 - DNA, 20 bp, synthetic construct
  source 1..20: mol_type = other DNA
ccatccctggactccggcca

SEQ ID NO: 9321 - DNA, 18 bp, synthetic construct
  source 1..18: mol_type = other DNA
ggactgagattgccccca

SEQ ID NO: 9322 - DNA, 20 bp, synthetic construct
  source 1..20: mol_type = other DNA
gatggctcagctcctgggga

SEQ ID NO: 9323 - DNA, 21 bp, synthetic construct
  source 1..21: mol_type = other DNA
catgtgaagcagcaaggccca

SEQ ID NO: 9324 - DNA, 20 bp, synthetic construct
  source 1..20: mol_type = other DNA
cacgttgcaatgagaggcaa

SEQ ID NO: 9325 - DNA, 22 bp, synthetic construct
  source 1..22: mol_type = other DNA
agaagcggcctaggacagaaca

SEQ ID NO: 9326 - DNA, 20 bp, synthetic construct
  source 1..20: mol_type = other DNA
aagtccagcctagggcagca

SEQ ID NO: 9327 - DNA, 21 bp, synthetic construct
  source 1..21: mol_type = other DNA
gcgacctggtcacactaggca

SEQ ID NO: 9328 - DNA, 18 bp, synthetic construct
  source 1..18: mol_type = other DNA
ccgaagactgcatcgcca

SEQ ID NO: 9329 - DNA, 21 bp, synthetic construct
  source 1..21: mol_type = other DNA
gtatggtggatgcctgggcaa

SEQ ID NO: 9330 - DNA, 18 bp, synthetic construct
  source 1..18: mol_type = other DNA
cggtgggtgtcaccggaa

SEQ ID NO: 9331 - DNA, 19 bp, synthetic construct
  source 1..19: mol_type = other DNA
tgcttcagctccacggaga

SEQ ID NO: 9332 - DNA, 18 bp, synthetic construct
  source 1..18: mol_type = other DNA
agcccagtgtgtggcaga

SEQ ID NO: 9333 - DNA, 19 bp, synthetic construct
  source 1..19: mol_type = other DNA
tcctgctcaactccccaca

SEQ ID NO: 9334 - DNA, 20 bp, synthetic construct
  source 1..20: mol_type = other DNA
gtgcagccctaccaagacca

SEQ ID NO: 9335 - DNA, 19 bp, synthetic construct
  source 1..19: mol_type = other DNA
gcagcgctgtgtcaacaca

SEQ ID NO: 9336 - DNA, 18 bp, synthetic construct
  source 1..18: mol_type = other DNA
actcgtgcccaatcccga

SEQ ID NO: 9337 - DNA, 20 bp, synthetic construct
  source 1..20: mol_type = other DNA
cctcagagtcgaggtgccca

SEQ ID NO: 9338 - DNA, 19 bp, synthetic construct
  source 1..19: mol_type = other DNA
ggaacaaccggccggcaga

SEQ ID NO: 9339 - DNA, 20 bp, synthetic construct
  source 1..20: mol_type = other DNA
cagcatctgtgcccagagca

SEQ ID NO: 9340 - DNA, 21 bp, synthetic construct
  source 1..21: mol_type = other DNA
gacccgtgagacaaagaagca

SEQ ID NO: 9341 - DNA, 20 bp, synthetic construct
  source 1..20: mol_type = other DNA
ggccctctcagactccgaga

SEQ ID NO: 9342 - DNA, 18 bp, synthetic construct
  source 1..18: mol_type = other DNA
aggaggaatggagcccca

SEQ ID NO: 9343 - DNA, 21 bp, synthetic construct
  source 1..21: mol_type = other DNA
ccggggcttcaccaagaccta

SEQ ID NO: 9344 - DNA, 22 bp, synthetic construct
  source 1..22: mol_type = other DNA
ccatgaggcactgggaaaagca

SEQ ID NO: 9345 - DNA, 19 bp, synthetic construct
  source 1..19: mol_type = other DNA
tcggatgcctcagtgcaga

SEQ ID NO: 9346 - DNA, 18 bp, synthetic construct
  source 1..18: mol_type = other DNA
gctggaacccattccgca

SEQ ID NO: 9347 - DNA, 18 bp, synthetic construct
  source 1..18: mol_type = other DNA
gcagcaagcactggccaa

SEQ ID NO: 9348 - DNA, 19 bp, synthetic construct
  source 1..19: mol_type = other DNA
cacaggccaggaatggaga

SEQ ID NO: 9349 - DNA, 20 bp, synthetic construct
  source 1..20: mol_type = other DNA
tggatcaaggaccagaggca

SEQ ID NO: 9350 - DNA, 20 bp, synthetic construct
  source 1..20: mol_type = other DNA
cgtcaccatcggtgccacca

SEQ ID NO: 9351 - DNA, 22 bp, synthetic construct
  source 1..22: mol_type = other DNA
tggcagactgggtgtacaacga

SEQ ID NO: 9352 - DNA, 21 bp, synthetic construct
  source 1..21: mol_type = other DNA
cgaggacctcaaagtgggaca

SEQ ID NO: 9353 - DNA, 18 bp, synthetic construct
  source 1..18: mol_type = other DNA
ctgcacggtgcgggacca

SEQ ID NO: 9354 - DNA, 18 bp, synthetic construct
  source 1..18: mol_type = other DNA
ccggcagattggaggcga

SEQ ID NO: 9355 - DNA, 22 bp, synthetic construct
  source 1..22: mol_type = other DNA
gaaatctgtcaggtcagcccaa

SEQ ID NO: 9356 - DNA, 20 bp, synthetic construct
  source 1..20: mol_type = other DNA
tccatcgaacccatccgcga

SEQ ID NO: 9357 - DNA, 18 bp, synthetic construct
  source 1..18: mol_type = other DNA
gaaggaccccgacggcaa

SEQ ID NO: 9358 - DNA, 18 bp, synthetic construct
  source 1..18: mol_type = other DNA
gggtgcaggctgctcgca

SEQ ID NO: 9359 - DNA, 20 bp, synthetic construct
  source 1..20: mol_type = other DNA
aagcagcgggaggagtacca

SEQ ID NO: 9360 - DNA, 20 bp, synthetic construct
  source 1..20: mol_type = other DNA
cggcggcaaaggcaagagca

SEQ ID NO: 9361 - DNA, 19 bp, synthetic construct
  source 1..19: mol_type = other DNA
ccgccctacctcacaagca

SEQ ID NO: 9362 - DNA, 20 bp, synthetic construct
  source 1..20: mol_type = other DNA
cctgtgagagtgggggagga

SEQ ID NO: 9363 - DNA, 20 bp, synthetic construct
  source 1..20: mol_type = other DNA
cctaccccatcccacagcca

SEQ ID NO: 9364 - DNA, 21 bp, synthetic construct
  source 1..21: mol_type = other DNA
cctgaggctgcagcagaagca

SEQ ID NO: 9365 - DNA, 18 bp, synthetic construct
  source 1..18: mol_type = other DNA
atcgaccaggatgggcca

SEQ ID NO: 9366 - DNA, 20 bp, synthetic construct
  source 1..20: mol_type = other DNA
aaacttggcaagatgcacca

SEQ ID NO: 9367 - DNA, 22 bp, synthetic construct
  source 1..22: mol_type = other DNA
gcaacactggactgtcaaccca

SEQ ID NO: 9368 - DNA, 21 bp, synthetic construct
  source 1..21: mol_type = other DNA
cctccgtctacgcctacacca

SEQ ID NO: 9369 - DNA, 19 bp, synthetic construct
  source 1..19: mol_type = other DNA
gcgagtgcaggtacgagga

SEQ ID NO: 9370 - DNA, 20 bp, synthetic construct
  source 1..20: mol_type = other DNA
cagggacggctctcctggca

SEQ ID NO: 9371 - DNA, 20 bp, synthetic construct
  source 1..20: mol_type = other DNA
gggagtcaggaccctctcca

SEQ ID NO: 9372 - DNA, 18 bp, synthetic construct
  source 1..18: mol_type = other DNA
ctgcggctctgcgccaca

SEQ ID NO: 9373 - DNA, 21 bp, synthetic construct
  source 1..21: mol_type = other DNA
ttgcaggatgcggaggaggaa

SEQ ID NO: 9374 - DNA, 20 bp, synthetic construct
  source 1..20: mol_type = other DNA
aggggtacagtgggacagca

SEQ ID NO: 9375 - DNA, 25 bp, synthetic construct
  source 1..25: mol_type = other DNA
aatagcatgtgacacaggacagcca

SEQ ID NO: 9376 - DNA, 20 bp, synthetic construct
  source 1..20: mol_type = other DNA
cacagcttcaagggggagga

SEQ ID NO: 9377 - DNA, 18 bp, synthetic construct
  source 1..18: mol_type = other DNA
ctgcacaggctgccggaa

SEQ ID NO: 9378 - DNA, 21 bp, synthetic construct
  source 1..21: mol_type = other DNA
agaaagtgggagcagaagaca

SEQ ID NO: 9379 - DNA, 20 bp, synthetic construct
  source 1..20: mol_type = other DNA
acgatgccgcaggagagaga

SEQ ID NO: 9380 - DNA, 18 bp, synthetic construct
  source 1..18: mol_type = other DNA
agcccctggacaaggtca

SEQ ID NO: 9381 - DNA, 21 bp, synthetic construct
  source 1..21: mol_type = other DNA
tgcaaggaggacgagtaccca

SEQ ID NO: 9382 - DNA, 20 bp, synthetic construct
  source 1..20: mol_type = other DNA
ctgcatcaagagcaaaccga

SEQ ID NO: 9383 - DNA, 21 bp, synthetic construct
  source 1..21: mol_type = other DNA
caggagggagagagagacaca

SEQ ID NO: 9384 - DNA, 20 bp, synthetic construct
  source 1..20: mol_type = other DNA
aagagggggagcttgaagga

SEQ ID NO: 9385 - DNA, 18 bp, synthetic construct
  source 1..18: mol_type = other DNA
agaagtccagcacgccca

SEQ ID NO: 9386 - DNA, 18 bp, synthetic construct
  source 1..18: mol_type = other DNA
ccttggacagcgcccaca

SEQ ID NO: 9387 - DNA, 19 bp, synthetic construct
  source 1..19: mol_type = other DNA
gcccagaacctcacaggga

SEQ ID NO: 9388 - DNA, 20 bp, synthetic construct
  source 1..20: mol_type = other DNA
ctgcatcacccacagccgca

SEQ ID NO: 9389 - DNA, 18 bp, synthetic construct
  source 1..18: mol_type = other DNA
tgggacgaaggagaggga

SEQ ID NO: 9390 - DNA, 18 bp, synthetic construct
  source 1..18: mol_type = other DNA
gacccagcctgggacaga

SEQ ID NO: 9391 - DNA, 20 bp, synthetic construct
  source 1..20: mol_type = other DNA
cagaggtgatgtggcaacca

SEQ ID NO: 9392 - DNA, 18 bp, synthetic construct
  source 1..18: mol_type = other DNA
accccgctaccccgagga

SEQ ID NO: 9393 - DNA, 21 bp, synthetic construct
  source 1..21: mol_type = other DNA
ggccaagtggctcccaatgca

SEQ ID NO: 9394 - DNA, 18 bp, synthetic construct
  source 1..18: mol_type = other DNA
gcagcccacctggacaga

SEQ ID NO: 9395 - DNA, 18 bp, synthetic construct
  source 1..18: mol_type = other DNA
gcaatgaggccctgcaca

SEQ ID NO: 9396 - DNA, 20 bp, synthetic construct
  source 1..20: mol_type = other DNA
acagaggtagtgcagggcaa

SEQ ID NO: 9397 - DNA, 18 bp, synthetic construct
  source 1..18: mol_type = other DNA
tggcgcctacacgggaga

SEQ ID NO: 9398 - DNA, 20 bp, synthetic construct
  source 1..20: mol_type = other DNA
ccaagctccacccaagtcaa

SEQ ID NO: 9399 - DNA, 18 bp, synthetic construct
  source 1..18: mol_type = other DNA
gccagggacccaggagga

SEQ ID NO: 9400 - DNA, 21 bp, synthetic construct
  source 1..21: mol_type = other DNA
caggtcaccaagatgctggca

SEQ ID NO: 9401 - DNA, 20 bp, synthetic construct
  source 1..20: mol_type = other DNA
tgcccccaacatggccagaa

SEQ ID NO: 9402 - DNA, 21 bp, synthetic construct
  source 1..21: mol_type = other DNA
actgggcttcatgggagcaga

SEQ ID NO: 9403 - DNA, 21 bp, synthetic construct
  source 1..21: mol_type = other DNA
gcccagtacgcagactctgaa

SEQ ID NO: 9404 - DNA, 21 bp, synthetic construct
  source 1..21: mol_type = other DNA
tgaggacttacacggacgcta

SEQ ID NO: 9405 - DNA, 21 bp, synthetic construct
  source 1..21: mol_type = other DNA
gtggcgacaggtatcctagga

SEQ ID NO: 9406 - DNA, 18 bp, synthetic construct
  source 1..18: mol_type = other DNA
cggctcacagtcccccga

SEQ ID NO: 9407 - DNA, 19 bp, synthetic construct
  source 1..19: mol_type = other DNA
cccgcacacctggcagcaa

SEQ ID NO: 9408 - DNA, 20 bp, synthetic construct
  source 1..20: mol_type = other DNA
tgaggagtatcccgaccgca

SEQ ID NO: 9409 - DNA, 18 bp, synthetic construct
  source 1..18: mol_type = other DNA
ggcagcagaagaggccaa

SEQ ID NO: 9410 - DNA, 18 bp, synthetic construct
  source 1..18: mol_type = other DNA
aatggaacgcccgaggga

SEQ ID NO: 9411 - DNA, 18 bp, synthetic construct
  source 1..18: mol_type = other DNA
gcatgctggcagaggaca

SEQ ID NO: 9412 - DNA, 18 bp, synthetic construct
  source 1..18: mol_type = other DNA
gcaccgaggatgggccaa

SEQ ID NO: 9413 - DNA, 22 bp, synthetic construct
  source 1..22: mol_type = other DNA
accagagtacaggcaaaaggca

SEQ ID NO: 9414 - DNA, 22 bp, synthetic construct
  source 1..22: mol_type = other DNA
cagctggagaattacacaccca

SEQ ID NO: 9415 - DNA, 19 bp, synthetic construct
  source 1..19: mol_type = other DNA
ctgagagaggtggggcaga

SEQ ID NO: 9416 - DNA, 18 bp, synthetic construct
  source 1..18: mol_type = other DNA
ccaggacagatgcccaca

SEQ ID NO: 9417 - DNA, 20 bp, synthetic construct
  source 1..20: mol_type = other DNA
ccacaacctgcgcctatcca

SEQ ID NO: 9418 - DNA, 21 bp, synthetic construct
  source 1..21: mol_type = other DNA
tcccactgtccatccgccaga

SEQ ID NO: 9419 - DNA, 21 bp, synthetic construct
  source 1..21: mol_type = other DNA
cagcctgtgaacatcaaggca

SEQ ID NO: 9420 - DNA, 20 bp, synthetic construct
  source 1..20: mol_type = other DNA
ctccagaggaacaagggcaa

SEQ ID NO: 9421 - DNA, 19 bp, synthetic construct
  source 1..19: mol_type = other DNA
gcagcagcgttcagaccaa

SEQ ID NO: 9422 - DNA, 20 bp, synthetic construct
  source 1..20: mol_type = other DNA
cagtgaaggaagctcccgga

SEQ ID NO: 9423 - DNA, 19 bp, synthetic construct
  source 1..19: mol_type = other DNA
ccagttgaaggatgcggga

SEQ ID NO: 9424 - DNA, 19 bp, synthetic construct
  source 1..19: mol_type = other DNA
gggcacagaccactgagca

SEQ ID NO: 9425 - DNA, 19 bp, synthetic construct
  source 1..19: mol_type = other DNA
gggtacaagcgggagcaca

SEQ ID NO: 9426 - DNA, 18 bp, synthetic construct
  source 1..18: mol_type = other DNA
acaagacctgccccacca

SEQ ID NO: 9427 - DNA, 18 bp, synthetic construct
  source 1..18: mol_type = other DNA
gaaccccaaataccggca

SEQ ID NO: 9428 - DNA, 22 bp, synthetic construct
  source 1..22: mol_type = other DNA
aatgtacccaaggagcctgaga

SEQ ID NO: 9429 - DNA, 21 bp, synthetic construct
  source 1..21: mol_type = other DNA
ccgtgtcaagacccccacaga

SEQ ID NO: 9430 - DNA, 18 bp, synthetic construct
  source 1..18: mol_type = other DNA
ccagctgtcggatggcaa

SEQ ID NO: 9431 - DNA, 18 bp, synthetic construct
  source 1..18: mol_type = other DNA
cgaggccaaagtcaggca

SEQ ID NO: 9432 - DNA, 20 bp, synthetic construct
  source 1..20: mol_type = other DNA
cagagctcggcagaaaacga

SEQ ID NO: 9433 - DNA, 21 bp, synthetic construct
  source 1..21: mol_type = other DNA
ctcccagaaaaggcggaagga

SEQ ID NO: 9434 - DNA, 18 bp, synthetic construct
  source 1..18: mol_type = other DNA
ctgccacctgtgaaccca

SEQ ID NO: 9435 - DNA, 18 bp, synthetic construct
  source 1..18: mol_type = other DNA
actgcagctcagccccaa

SEQ ID NO: 9436 - DNA, 18 bp, synthetic construct
  source 1..18: mol_type = other DNA
cgggacacaagacaggca

SEQ ID NO: 9437 - DNA, 18 bp, synthetic construct
  source 1..18: mol_type = other DNA
acaagacgtcggagggca

SEQ ID NO: 9438 - DNA, 18 bp, synthetic construct
  source 1..18: mol_type = other DNA
acaagacctcggagggca

SEQ ID NO: 9439 - DNA, 18 bp, synthetic construct
  source 1..18: mol_type = other DNA
aggggccctcctcgccaa

SEQ ID NO: 9440 - DNA, 21 bp, synthetic construct
  source 1..21: mol_type = other DNA
gcaacgggaagctgagaggca

SEQ ID NO: 9441 - DNA, 18 bp, synthetic construct
  source 1..18: mol_type = other DNA
agaccacgtctgtgcgga

SEQ ID NO: 9442 - DNA, 19 bp, synthetic construct
  source 1..19: mol_type = other DNA
cgccagctctggctacgaa

SEQ ID NO: 9443 - DNA, 20 bp, synthetic construct
  source 1..20: mol_type = other DNA
cggaagagcttcagccacca

SEQ ID NO: 9444 - DNA, 25 bp, synthetic construct
  source 1..25: mol_type = other DNA
ctggtccaacaaccaacaacatgga

SEQ ID NO: 9445 - DNA, 20 bp, synthetic construct
  source 1..20: mol_type = other DNA
aaggtgagccggtccgagac

SEQ ID NO: 9446 - DNA, 19 bp, synthetic construct
  source 1..19: mol_type = other DNA
agacggtccctctcccgac

SEQ ID NO: 9447 - DNA, 21 bp, synthetic construct
  source 1..21: mol_type = other DNA
acacgcactcggtccgattcg

SEQ ID NO: 9448 - DNA, 20 bp, synthetic construct
  source 1..20: mol_type = other DNA
acgggaagactaagtccgtc

SEQ ID NO: 9449 - DNA, 18 bp, synthetic construct
  source 1..18: mol_type = other DNA
acggcgaccacgttagag

SEQ ID NO: 9450 - DNA, 19 bp, synthetic construct
  source 1..19: mol_type = other DNA
aggaatcccagaccgaccc

SEQ ID NO: 9451 - DNA, 18 bp, synthetic construct
  source 1..18: mol_type = other DNA
aggaccacgacgcgtaga

SEQ ID NO: 9452 - DNA, 21 bp, synthetic construct
  source 1..21: mol_type = other DNA
aacgacgccttcctaccacta

SEQ ID NO: 9453 - DNA, 22 bp, synthetic construct
  source 1..22: mol_type = other DNA
aagacacagacggagacagccg

SEQ ID NO: 9454 - DNA, 18 bp, synthetic construct
  source 1..18: mol_type = other DNA
agacggcgcagcattagg

SEQ ID NO: 9455 - DNA, 19 bp, synthetic construct
  source 1..19: mol_type = other DNA
aggacaaggagcccacacg

SEQ ID NO: 9456 - DNA, 18 bp, synthetic construct
  source 1..18: mol_type = other DNA
aagggacctcggagtcct

SEQ ID NO: 9457 - DNA, 19 bp, synthetic construct
  source 1..19: mol_type = other DNA
aggagggggtcaagtgggg

SEQ ID NO: 9458 - DNA, 18 bp, synthetic construct
  source 1..18: mol_type = other DNA
aaccgaccggccaacttg

SEQ ID NO: 9459 - DNA, 18 bp, synthetic construct
  source 1..18: mol_type = other DNA
aacccggcttgaaagacc

SEQ ID NO: 9460 - DNA, 19 bp, synthetic construct
  source 1..19: mol_type = other DNA
agtgtgtggagggaggacc

SEQ ID NO: 9461 - DNA, 19 bp, synthetic construct
  source 1..19: mol_type = other DNA
acggcaacatcatccgggc

SEQ ID NO: 9462 - DNA, 18 bp, synthetic construct
  source 1..18: mol_type = other DNA
agccccaacgagtaggga

SEQ ID NO: 9463 - DNA, 18 bp, synthetic construct
  source 1..18: mol_type = other DNA
aacgcccgaacccgttac

SEQ ID NO: 9464 - DNA, 18 bp, synthetic construct
  source 1..18: mol_type = other DNA
agcacactactccacggg

SEQ ID NO: 9465 - DNA, 22 bp, synthetic construct
  source 1..22: mol_type = other DNA
aaccgtataacccaacaccgtc

SEQ ID NO: 9466 - DNA, 20 bp, synthetic construct
  source 1..20: mol_type = other DNA
aggtctcgacgggggcctac

SEQ ID NO: 9467 - DNA, 18 bp, synthetic construct
  source 1..18: mol_type = other DNA
acccacgacaccaggtgc

SEQ ID NO: 9468 - DNA, 20 bp, synthetic construct
  source 1..20: mol_type = other DNA
agccagtcgagaacaacgtc

SEQ ID NO: 9469 - DNA, 18 bp, synthetic construct
  source 1..18: mol_type = other DNA
accagtaagagggtcggt

SEQ ID NO: 9470 - DNA, 18 bp, synthetic construct
  source 1..18: mol_type = other DNA
aagcaggaacctcccagc

SEQ ID NO: 9471 - DNA, 18 bp, synthetic construct
  source 1..18: mol_type = other DNA
acggcaaaaggacccgac

SEQ ID NO: 9472 - DNA, 22 bp, synthetic construct
  source 1..22: mol_type = other DNA
acccgagtcaatctcaggctat

SEQ ID NO: 9473 - DNA, 18 bp, synthetic construct
  source 1..18: mol_type = other DNA
aggggcctcggcggagag

SEQ ID NO: 9474 - DNA, 18 bp, synthetic construct
  source 1..18: mol_type = other DNA
accagtcccgtcacccga

SEQ ID NO: 9475 - DNA, 21 bp, synthetic construct
  source 1..21: mol_type = other DNA
agagagttacccgacctgaga

SEQ ID NO: 9476 - DNA, 20 bp, synthetic construct
  source 1..20: mol_type = other DNA
agagatggacgaggccacgg

SEQ ID NO: 9477 - DNA, 20 bp, synthetic construct
  source 1..20: mol_type = other DNA
acgaagcacgatccctgcaa

SEQ ID NO: 9478 - DNA, 18 bp, synthetic construct
  source 1..18: mol_type = other DNA
agggcaggcgcaaggtcg

SEQ ID NO: 9479 - DNA, 18 bp, synthetic construct
  source 1..18: mol_type = other DNA
acgccatgaccggcaaca

SEQ ID NO: 9480 - DNA, 18 bp, synthetic construct
  source 1..18: mol_type = other DNA
agagggtgcaccactacc

SEQ ID NO: 9481 - DNA, 20 bp, synthetic construct
  source 1..20: mol_type = other DNA
aactcgacccgtgtccgacg

SEQ ID NO: 9482 - DNA, 20 bp, synthetic construct
  source 1..20: mol_type = other DNA
aggagaaaacagccggatcc

SEQ ID NO: 9483 - DNA, 18 bp, synthetic construct
  source 1..18: mol_type = other DNA
acgggtccacaccaggag

SEQ ID NO: 9484 - DNA, 21 bp, synthetic construct
  source 1..21: mol_type = other DNA
agcactcgcactcatctccgg

SEQ ID NO: 9485 - DNA, 18 bp, synthetic construct
  source 1..18: mol_type = other DNA
agaggtccaccctcccca

SEQ ID NO: 9486 - DNA, 20 bp, synthetic construct
  source 1..20: mol_type = other DNA
agcaggtacacacacgtcat

SEQ ID NO: 9487 - DNA, 20 bp, synthetic construct
  source 1..20: mol_type = other DNA
aggaggacacccgagtacca

SEQ ID NO: 9488 - DNA, 18 bp, synthetic construct
  source 1..18: mol_type = other DNA
acgactcgctacaggacg

SEQ ID NO: 9489 - DNA, 19 bp, synthetic construct
  source 1..19: mol_type = other DNA
agcgccagagacgtgatcg

SEQ ID NO: 9490 - DNA, 18 bp, synthetic construct
  source 1..18: mol_type = other DNA
accccgaagggctaccga

SEQ ID NO: 9491 - DNA, 18 bp, synthetic construct
  source 1..18: mol_type = other DNA
accagtcccggtaagacc

SEQ ID NO: 9492 - DNA, 18 bp, synthetic construct
  source 1..18: mol_type = other DNA
acacgtcggcatccacgg

SEQ ID NO: 9493 - DNA, 20 bp, synthetic construct
  source 1..20: mol_type = other DNA
acagagggagggagtggtgt

SEQ ID NO: 9494 - DNA, 21 bp, synthetic construct
  source 1..21: mol_type = other DNA
acccaaaggtgtgagtcggtc

SEQ ID NO: 9495 - DNA, 22 bp, synthetic construct
  source 1..22: mol_type = other DNA
aggaaaccgttgaatccgagaa

SEQ ID NO: 9496 - DNA, 20 bp, synthetic construct
  source 1..20: mol_type = other DNA
agacccacctaggttcacgg

SEQ ID NO: 9497 - DNA, 22 bp, synthetic construct
  source 1..22: mol_type = other DNA
agcgagacagaaatgggtaaga

SEQ ID NO: 9498 - DNA, 20 bp, synthetic construct
  source 1..20: mol_type = other DNA
aggagtccaaagagacgcag

SEQ ID NO: 9499 - DNA, 21 bp, synthetic construct
  source 1..21: mol_type = other DNA
agccagtcacagcttgacaaa

SEQ ID NO: 9500 - DNA, 18 bp, synthetic construct
  source 1..18: mol_type = other DNA
aacgtaggtcggaaaggt

SEQ ID NO: 9501 - DNA, 18 bp, synthetic construct
  source 1..18: mol_type = other DNA
agtggaaggtgtgcggca

SEQ ID NO: 9502 - DNA, 18 bp, synthetic construct
  source 1..18: mol_type = other DNA
accaccacaaccgacgac

SEQ ID NO: 9503 - DNA, 20 bp, synthetic construct
  source 1..20: mol_type = other DNA
acacgagaggaacccaggag

SEQ ID NO: 9504 - DNA, 20 bp, synthetic construct
  source 1..20: mol_type = other DNA
aactgcccgtcacggagtcg

SEQ ID NO: 9505 - DNA, 20 bp, synthetic construct
  source 1..20: mol_type = other DNA
accctgcaactcacgtagac

SEQ ID NO: 9506 - DNA, 19 bp, synthetic construct
  source 1..19: mol_type = other DNA
agggccgggtgtaaccagg

SEQ ID NO: 9507 - DNA, 18 bp, synthetic construct
  source 1..18: mol_type = other DNA
agaccgactcgctcggga

SEQ ID NO: 9508 - DNA, 18 bp, synthetic construct
  source 1..18: mol_type = other DNA
acagaaggtacaaccgcg

SEQ ID NO: 9509 - DNA, 22 bp, synthetic construct
  source 1..22: mol_type = other DNA
acctccaaagaccaaaccagag

SEQ ID NO: 9510 - DNA, 18 bp, synthetic construct
  source 1..18: mol_type = other DNA
acgcacatccgctagtgg

SEQ ID NO: 9511 - DNA, 18 bp, synthetic construct
  source 1..18: mol_type = other DNA
agcgcgcgtcggtcatct

SEQ ID NO: 9512 - DNA, 19 bp, synthetic construct
  source 1..19: mol_type = other DNA
aagtggcgagagcaaccat

SEQ ID NO: 9513 - DNA, 18 bp, synthetic construct
  source 1..18: mol_type = other DNA
agtggcccaagtacgtcg

SEQ ID NO: 9514 - DNA, 22 bp, synthetic construct
  source 1..22: mol_type = other DNA
acgacgttccaggactactagt

SEQ ID NO: 9515 - DNA, 20 bp, synthetic construct
  source 1..20: mol_type = other DNA
aaggaccctctctgcgtttg

SEQ ID NO: 9516 - DNA, 21 bp, synthetic construct
  source 1..21: mol_type = other DNA
accgctacatggccaggtacg

SEQ ID NO: 9517 - DNA, 18 bp, synthetic construct
  source 1..18: mol_type = other DNA
aaccggtggcagacccgg

SEQ ID NO: 9518 - DNA, 20 bp, synthetic construct
  source 1..20: mol_type = other DNA
aacgccgactgccgagtagt

SEQ ID NO: 9519 - DNA, 19 bp, synthetic construct
  source 1..19: mol_type = other DNA
accaaccttccgaacctcg

SEQ ID NO: 9520 - DNA, 18 bp, synthetic construct
  source 1..18: mol_type = other DNA
aaggacacaacgcgtcgc

SEQ ID NO: 9521 - DNA, 20 bp, synthetic construct
  source 1..20: mol_type = other DNA
aggtgagtgacagagcggtc

SEQ ID NO: 9522 - DNA, 21 bp, synthetic construct
  source 1..21: mol_type = other DNA
agggcagtgacacatcaaggg

SEQ ID NO: 9523 - DNA, 20 bp, synthetic construct
  source 1..20: mol_type = other DNA
accggtcagagaagagggta

SEQ ID NO: 9524 - DNA, 18 bp, synthetic construct
  source 1..18: mol_type = other DNA
agcagtgcaagcccacga

SEQ ID NO: 9525 - DNA, 19 bp, synthetic construct
  source 1..19: mol_type = other DNA
accccgtccagtaagcccc

SEQ ID NO: 9526 - DNA, 20 bp, synthetic construct
  source 1..20: mol_type = other DNA
acagtccgacaacaccgaat

SEQ ID NO: 9527 - DNA, 18 bp, synthetic construct
  source 1..18: mol_type = other DNA
accagtccaacggtgcca

SEQ ID NO: 9528 - DNA, 18 bp, synthetic construct
  source 1..18: mol_type = other DNA
agcccgaagtgaacggcg

SEQ ID NO: 9529 - DNA, 20 bp, synthetic construct
  source 1..20: mol_type = other DNA
acgatacgggacctagagtt

SEQ ID NO: 9530 - DNA, 19 bp, synthetic construct
  source 1..19: mol_type = other DNA
acgggtcaacgaggacaag

SEQ ID NO: 9531 - DNA, 18 bp, synthetic construct
  source 1..18: mol_type = other DNA
acaggggaccgactcacg

SEQ ID NO: 9532 - DNA, 20 bp, synthetic construct
  source 1..20: mol_type = other DNA
agagggagacgactgaaggg

SEQ ID NO: 9533 - DNA, 21 bp, synthetic construct
  source 1..21: mol_type = other DNA
acgactgaaacaagggacgac

SEQ ID NO: 9534 - DNA, 21 bp, synthetic construct
  source 1..21: mol_type = other DNA
accagggtaaacccactctgt

SEQ ID NO: 9535 - DNA, 20 bp, synthetic construct
  source 1..20: mol_type = other DNA
acacgtccttccgaccggag

SEQ ID NO: 9536 - DNA, 21 bp, synthetic construct
  source 1..21: mol_type = other DNA
aggacgagtgagagactccag

SEQ ID NO: 9537 - DNA, 18 bp, synthetic construct
  source 1..18: mol_type = other DNA
agcacggtcaaggcgacc

SEQ ID NO: 9538 - DNA, 18 bp, synthetic construct
  source 1..18: mol_type = other DNA
aaccgcagcgagagtgtc

SEQ ID NO: 9539 - DNA, 18 bp, synthetic construct
  source 1..18: mol_type = other DNA
aggacgacccagggctag

SEQ ID NO: 9540 - DNA, 17 bp, synthetic construct
  source 1..17: mol_type = other DNA
acgagacgggtacaggg

SEQ ID NO: 9541 - DNA, 21 bp, synthetic construct
  source 1..21: mol_type = other DNA
aggacctaggtctgaaggacc

SEQ ID NO: 9542 - DNA, 21 bp, synthetic construct
  source 1..21: mol_type = other DNA
agacgcgaggacgacttgaag

SEQ ID NO: 9543 - DNA, 18 bp, synthetic construct
  source 1..18: mol_type = other DNA
aaccccaccggtcaccca

SEQ ID NO: 9544 - DNA, 21 bp, synthetic construct
  source 1..21: mol_type = other DNA
aagcgaacatcagccgtggtg

SEQ ID NO: 9545 - DNA, 18 bp, synthetic construct
  source 1..18: mol_type = other DNA
acgagcaaccggtagacg

SEQ ID NO: 9546 - DNA, 17 bp, synthetic construct
  source 1..17: mol_type = other DNA
acccgctgacgaagtgg

SEQ ID NO: 9547 - DNA, 20 bp, synthetic construct
  source 1..20: mol_type = other DNA
aggggccacgactccaaagc

SEQ ID NO: 9548 - DNA, 18 bp, synthetic construct
  source 1..18: mol_type = other DNA
agggccgacgaaagacga

SEQ ID NO: 9549 - DNA, 20 bp, synthetic construct
  source 1..20: mol_type = other DNA
agtggacagaactacacgtc

SEQ ID NO: 9550 - DNA, 18 bp, synthetic construct
  source 1..18: mol_type = other DNA
agggaggaggaccgcaga

SEQ ID NO: 9551 - DNA, 18 bp, synthetic construct
  source 1..18: mol_type = other DNA
aggcgtgtcgacctccag

SEQ ID NO: 9552 - DNA, 18 bp, synthetic construct
  source 1..18: mol_type = other DNA
aggagtcgcaggacccaa

SEQ ID NO: 9553 - DNA, 18 bp, synthetic construct
  source 1..18: mol_type = other DNA
agcaaccagcggctgttc

SEQ ID NO: 9554 - DNA, 18 bp, synthetic construct
  source 1..18: mol_type = other DNA
acagggcgacctggacac

SEQ ID NO: 9555 - DNA, 18 bp, synthetic construct
  source 1..18: mol_type = other DNA
acgcaaaagggtccaggt

SEQ ID NO: 9556 - DNA, 20 bp, synthetic construct
  source 1..20: mol_type = other DNA
aggagcacagtgtccgaacc

SEQ ID NO: 9557 - DNA, 18 bp, synthetic construct
  source 1..18: mol_type = other DNA
agggagctcccaggaacc

SEQ ID NO: 9558 - DNA, 20 bp, synthetic construct
  source 1..20: mol_type = other DNA
acagggctcagtgagtcgtc

SEQ ID NO: 9559 - DNA, 19 bp, synthetic construct
  source 1..19: mol_type = other DNA
accagagtgtcgaacaggt

SEQ ID NO: 9560 - DNA, 21 bp, synthetic construct
  source 1..21: mol_type = other DNA
acacccataaacgtcgagact

SEQ ID NO: 9561 - DNA, 20 bp, synthetic construct
  source 1..20: mol_type = other DNA
aacccgtccagacactgact

SEQ ID NO: 9562 - DNA, 18 bp, synthetic construct
  source 1..18: mol_type = other DNA
aacccccgaatggcgagg

SEQ ID NO: 9563 - DNA, 21 bp, synthetic construct
  source 1..21: mol_type = other DNA
atcgactcgactaggcgtcgt

SEQ ID NO: 9564 - DNA, 23 bp, synthetic construct
  source 1..23: mol_type = other DNA
acatccacgacaacaggagaaag

SEQ ID NO: 9565 - DNA, 20 bp, synthetic construct
  source 1..20: mol_type = other DNA
acggaagtgtctacgacgac

SEQ ID NO: 9566 - DNA, 20 bp, synthetic construct
  source 1..20: mol_type = other DNA
accgaccacagcaaaacagg

SEQ ID NO: 9567 - DNA, 18 bp, synthetic construct
  source 1..18: mol_type = other DNA
acctacctcagggtgcga

SEQ ID NO: 9568 - DNA, 19 bp, synthetic construct
  source 1..19: mol_type = other DNA
agagggcctaatcccgtac

SEQ ID NO: 9569 - DNA, 18 bp, synthetic construct
  source 1..18: mol_type = other DNA
agcagcccggccggagac

SEQ ID NO: 9570 - DNA, 18 bp, synthetic construct
  source 1..18: mol_type = other DNA
aagggagttcgcccaaca

SEQ ID NO: 9571 - DNA, 19 bp, synthetic construct
  source 1..19: mol_type = other DNA
aggaaggaggttcccaccg

SEQ ID NO: 9572 - DNA, 19 bp, synthetic construct
  source 1..19: mol_type = other DNA
acctagcggaagagcaact

SEQ ID NO: 9573 - DNA, 18 bp, synthetic construct
  source 1..18: mol_type = other DNA
acacgacgcacccccttc

SEQ ID NO: 9574 - DNA, 19 bp, synthetic construct
  source 1..19: mol_type = other DNA
accgacagactaccgtaac

SEQ ID NO: 9575 - DNA, 19 bp, synthetic construct
  source 1..19: mol_type = other DNA
aacaggaccctgggactct

SEQ ID NO: 9576 - DNA, 20 bp, synthetic construct
  source 1..20: mol_type = other DNA
acaggtcgagaccaggtacg

SEQ ID NO: 9577 - DNA, 18 bp, synthetic construct
  source 1..18: mol_type = other DNA
aagcagacgacctcgacg

SEQ ID NO: 9578 - DNA, 18 bp, synthetic construct
  source 1..18: mol_type = other DNA
acgtgaacgagaggcccc

SEQ ID NO: 9579 - DNA, 20 bp, synthetic construct
  source 1..20: mol_type = other DNA
acgaccatactgagcaacgg

SEQ ID NO: 9580 - DNA, 18 bp, synthetic construct
  source 1..18: mol_type = other DNA
acgacccctaagagcagg

SEQ ID NO: 9581 - DNA, 18 bp, synthetic construct
  source 1..18: mol_type = other DNA
acgctcaaacacggtcga

SEQ ID NO: 9582 - DNA, 21 bp, synthetic construct
  source 1..21: mol_type = other DNA
acgacatcccggaccagtatc

SEQ ID NO: 9583 - DNA, 18 bp, synthetic construct
  source 1..18: mol_type = other DNA
acgggtccaagaggacgt

SEQ ID NO: 9584 - DNA, 19 bp, synthetic construct
  source 1..19: mol_type = other DNA
atcccggaaagtaaccccc

SEQ ID NO: 9585 - DNA, 19 bp, synthetic construct
  source 1..19: mol_type = other DNA
agacccgacatgtgcacat

SEQ ID NO: 9586 - DNA, 18 bp, synthetic construct
  source 1..18: mol_type = other DNA
aacgctccggcgaagaag

SEQ ID NO: 9587 - DNA, 19 bp, synthetic construct
  source 1..19: mol_type = other DNA
atcgggagcaagagagccg

SEQ ID NO: 9588 - DNA, 20 bp, synthetic construct
  source 1..20: mol_type = other DNA
aagggaagggcttccagtcg

SEQ ID NO: 9589 - DNA, 20 bp, synthetic construct
  source 1..20: mol_type = other DNA
acctaccgaaagtcgcaaag

SEQ ID NO: 9590 - DNA, 18 bp, synthetic construct
  source 1..18: mol_type = other DNA
accgcactacctacgacc

SEQ ID NO: 9591 - DNA, 18 bp, synthetic construct
  source 1..18: mol_type = other DNA
acgagaccgacacgacca

SEQ ID NO: 9592 - DNA, 18 bp, synthetic construct
  source 1..18: mol_type = other DNA
agccggagaaggggaaga

SEQ ID NO: 9593 - DNA, 20 bp, synthetic construct
  source 1..20: mol_type = other DNA
agcaccccgacgtcaatctc

SEQ ID NO: 9594 - DNA, 18 bp, synthetic construct
  source 1..18: mol_type = other DNA
accccataacccccgtag

SEQ ID NO: 9595 - DNA, 20 bp, synthetic construct
  source 1..20: mol_type = other DNA
accagtcacacggacacgac

SEQ ID NO: 9596 - DNA, 20 bp, synthetic construct
  source 1..20: mol_type = other DNA
acgagtccggccgcaagtct

SEQ ID NO: 9597 - DNA, 22 bp, synthetic construct
  source 1..22: mol_type = other DNA
aagcagtacccaccaaagggac

SEQ ID NO: 9598 - DNA, 20 bp, synthetic construct
  source 1..20: mol_type = other DNA
agacgatccgaccaggcttc

SEQ ID NO: 9599 - DNA, 21 bp, synthetic construct
  source 1..21: mol_type = other DNA
agacacacggaccatctgtca

SEQ ID NO: 9600 - DNA, 20 bp, synthetic construct
  source 1..20: mol_type = other DNA
aggactagagtcgcgaacac

SEQ ID NO: 9601 - DNA, 18 bp, synthetic construct
  source 1..18: mol_type = other DNA
acgacgtcgaccgagttc

SEQ ID NO: 9602 - DNA, 18 bp, synthetic construct
  source 1..18: mol_type = other DNA
accgggactagtggcagt

SEQ ID NO: 9603 - DNA, 20 bp, synthetic construct
  source 1..20: mol_type = other DNA
agcaaggacggtgaggttgg

SEQ ID NO: 9604 - DNA, 19 bp, synthetic construct
  source 1..19: mol_type = other DNA
agccgatacctgagcctcg

SEQ ID NO: 9605 - DNA, 18 bp, synthetic construct
  source 1..18: mol_type = other DNA
acagcgctcgacaacctc

SEQ ID NO: 9606 - DNA, 20 bp, synthetic construct
  source 1..20: mol_type = other DNA
aacgaacagagggtcaggtg

SEQ ID NO: 9607 - DNA, 18 bp, synthetic construct
  source 1..18: mol_type = other DNA
acgtgaacccagacgcag

SEQ ID NO: 9608 - DNA, 18 bp, synthetic construct
  source 1..18: mol_type = other DNA
aaggaccctgagcttggc

SEQ ID NO: 9609 - DNA, 21 bp, synthetic construct
  source 1..21: mol_type = other DNA
aacccttgacctcgacgacga

SEQ ID NO: 9610 - DNA, 18 bp, synthetic construct
  source 1..18: mol_type = other DNA
acgactcccaccacaacg

SEQ ID NO: 9611 - DNA, 20 bp, synthetic construct
  source 1..20: mol_type = other DNA
acaccaggataactccggtc

SEQ ID NO: 9612 - DNA, 18 bp, synthetic construct
  source 1..18: mol_type = other DNA
accacccccgtagacccg

SEQ ID NO: 9613 - DNA, 20 bp, synthetic construct
  source 1..20: mol_type = other DNA
acacaggccaaggacctgtc

SEQ ID NO: 9614 - DNA, 18 bp, synthetic construct
  source 1..18: mol_type = other DNA
aaggcgacatcggcgagt

SEQ ID NO: 9615 - DNA, 21 bp, synthetic construct
  source 1..21: mol_type = other DNA
accgaccgacactttccgacg

SEQ ID NO: 9616 - DNA, 18 bp, synthetic construct
  source 1..18: mol_type = other DNA
agtgaacgagtgggcgga

SEQ ID NO: 9617 - DNA, 21 bp, synthetic construct
  source 1..21: mol_type = other DNA
acgaatctcaggaggggctag

SEQ ID NO: 9618 - DNA, 19 bp, synthetic construct
  source 1..19: mol_type = other DNA
agaccgacccccaacatcg

SEQ ID NO: 9619 - DNA, 21 bp, synthetic construct
  source 1..21: mol_type = other DNA
acagggccaacaggaggagga

SEQ ID NO: 9620 - DNA, 20 bp, synthetic construct
  source 1..20: mol_type = other DNA
acgagtccaagtctcccgac

SEQ ID NO: 9621 - DNA, 18 bp, synthetic construct
  source 1..18: mol_type = other DNA
accccgagggacaccgaa

SEQ ID NO: 9622 - DNA, 18 bp, synthetic construct
  source 1..18: mol_type = other DNA
agggcaggaccgtcccca

SEQ ID NO: 9623 - DNA, 18 bp, synthetic construct
  source 1..18: mol_type = other DNA
acgggcctccctatcagc

SEQ ID NO: 9624 - DNA, 18 bp, synthetic construct
  source 1..18: mol_type = other DNA
acccgaccccacgaatac

SEQ ID NO: 9625 - DNA, 21 bp, synthetic construct
  source 1..21: mol_type = other DNA
agtgacgagggcagtatggcc

SEQ ID NO: 9626 - DNA, 21 bp, synthetic construct
  source 1..21: mol_type = other DNA
aacgtcacaccacctctccaa

SEQ ID NO: 9627 - DNA, 21 bp, synthetic construct
  source 1..21: mol_type = other DNA
accacagagagggtcgaagag

SEQ ID NO: 9628 - DNA, 20 bp, synthetic construct
  source 1..20: mol_type = other DNA
agtcgagacggtagggcgtc

SEQ ID NO: 9629 - DNA, 19 bp, synthetic construct
  source 1..19: mol_type = other DNA
aggtcgaaagacccgtacg

SEQ ID NO: 9630 - DNA, 21 bp, synthetic construct
  source 1..21: mol_type = other DNA
agcgactggaagacctagact

SEQ ID NO: 9631 - DNA, 20 bp, synthetic construct
  source 1..20: mol_type = other DNA
aggttccccaacccgtcgtc

SEQ ID NO: 9632 - DNA, 21 bp, synthetic construct
  source 1..21: mol_type = other DNA
agtcaaagagaccgcacaact

SEQ ID NO: 9633 - DNA, 21 bp, synthetic construct
  source 1..21: mol_type = other DNA
acagaccacgacccgataggg

SEQ ID NO: 9634 - DNA, 18 bp, synthetic construct
  source 1..18: mol_type = other DNA
accggaaccgaaaccgac

SEQ ID NO: 9635 - DNA, 20 bp, synthetic construct
  source 1..20: mol_type = other DNA
aggtccgcggcgaagaggaa

SEQ ID NO: 9636 - DNA, 21 bp, synthetic construct
  source 1..21: mol_type = other DNA
aggaagggtcgaagcaacgga

SEQ ID NO: 9637 - DNA, 19 bp, synthetic construct
  source 1..19: mol_type = other DNA
agcagcggaagagcatact

SEQ ID NO: 9638 - DNA, 20 bp, synthetic construct
  source 1..20: mol_type = other DNA
aacgtctcacagactcgggc

SEQ ID NO: 9639 - DNA, 18 bp, synthetic construct
  source 1..18: mol_type = other DNA
accccaagtacgtcgaca

SEQ ID NO: 9640 - DNA, 18 bp, synthetic construct
  source 1..18: mol_type = other DNA
acgaagagtcgtacgcgg

SEQ ID NO: 9641 - DNA, 21 bp, synthetic construct
  source 1..21: mol_type = other DNA
agcaacatccctagccactgg

SEQ ID NO: 9642 - DNA, 20 bp, synthetic construct
  source 1..20: mol_type = other DNA
acgtccagccacaagagtcc

SEQ ID NO: 9643 - DNA, 20 bp, synthetic construct
  source 1..20: mol_type = other DNA
agaccatgacgacggctcac

SEQ ID NO: 9644 - DNA, 20 bp, synthetic construct
  source 1..20: mol_type = other DNA
actggaccagtgactcgcat

SEQ ID NO: 9645 - DNA, 18 bp, synthetic construct
  source 1..18: mol_type = other DNA
accacgaccagcaccaga

SEQ ID NO: 9646 - DNA, 18 bp, synthetic construct
  source 1..18: mol_type = other DNA
aaccaacgatggtgcgcc

SEQ ID NO: 9647 - DNA, 20 bp, synthetic construct
  source 1..20: mol_type = other DNA
acatctccacgggacagagg

SEQ ID NO: 9648 - DNA, 17 bp, synthetic construct
  source 1..17: mol_type = other DNA
accgtgaccggccgagt

SEQ ID NO: 9649 - DNA, 20 bp, synthetic construct
  source 1..20: mol_type = other DNA
accgacatctcgaggtccgc

SEQ ID NO: 9650 - DNA, 18 bp, synthetic construct
  source 1..18: mol_type = other DNA
aacccggtcggagaggta

SEQ ID NO: 9651 - DNA, 18 bp, synthetic construct
  source 1..18: mol_type = other DNA
accaggtagaaccggacg

SEQ ID NO: 9652 - DNA, 20 bp, synthetic construct
  source 1..20: mol_type = other DNA
accgagacatccccgaagac

SEQ ID NO: 9653 - DNA, 18 bp, synthetic construct
  source 1..18: mol_type = other DNA
aacccaaggttgcggacc

SEQ ID NO: 9654 - DNA, 18 bp, synthetic construct
  source 1..18: mol_type = other DNA
acggcggaagaaacggtc

SEQ ID NO: 9655 - DNA, 19 bp, synthetic construct
  source 1..19: mol_type = other DNA
acacccggtgatcctggag

SEQ ID NO: 9656 - DNA, 20 bp, synthetic construct
  source 1..20: mol_type = other DNA
agaccatgtgcgcgacctgg

SEQ ID NO: 9657 - DNA, 18 bp, synthetic construct
  source 1..18: mol_type = other DNA
aacggtcgacgaagcagg

SEQ ID NO: 9658 - DNA, 20 bp, synthetic construct
  source 1..20: mol_type = other DNA
agacaatggagctccgggac

SEQ ID NO: 9659 - DNA, 19 bp, synthetic construct
  source 1..19: mol_type = other DNA
accaagtggtcatcccggc

SEQ ID NO: 9660 - DNA, 20 bp, synthetic construct
  source 1..20: mol_type = other DNA
agagagaggtgcaacgggtc

SEQ ID NO: 9661 - DNA, 18 bp, synthetic construct
  source 1..18: mol_type = other DNA
acaccgggaaaaggggga

SEQ ID NO: 9662 - DNA, 18 bp, synthetic construct
  source 1..18: mol_type = other DNA
accccgagtaagtggacc

SEQ ID NO: 9663 - DNA, 20 bp, synthetic construct
  source 1..20: mol_type = other DNA
agcaccgacatgacgtggtg

SEQ ID NO: 9664 - DNA, 18 bp, synthetic construct
  source 1..18: mol_type = other DNA
accaccagagtcgcgaca

SEQ ID NO: 9665 - DNA, 21 bp, synthetic construct
  source 1..21: mol_type = other DNA
acgacctcctcgacgaagaag

SEQ ID NO: 9666 - DNA, 18 bp, synthetic construct
  source 1..18: mol_type = other DNA
acccacgtgacccgtaag

SEQ ID NO: 9667 - DNA, 18 bp, synthetic construct
  source 1..18: mol_type = other DNA
agagggaagagcggagct

SEQ ID NO: 9668 - DNA, 18 bp, synthetic construct
  source 1..18: mol_type = other DNA
agcagcagcgtccgtagt

SEQ ID NO: 9669 - DNA, 18 bp, synthetic construct
  source 1..18: mol_type = other DNA
agccggagtaaaggccgc

SEQ ID NO: 9670 - DNA, 18 bp, synthetic construct
  source 1..18: mol_type = other DNA
acgggaccgacatccagg

SEQ ID NO: 9671 - DNA, 18 bp, synthetic construct
  source 1..18: mol_type = other DNA
aggaagtacgacgggtcc

SEQ ID NO: 9672 - DNA, 20 bp, synthetic construct
  source 1..20: mol_type = other DNA
agtccgaaaaactgccgaag

SEQ ID NO: 9673 - DNA, 18 bp, synthetic construct
  source 1..18: mol_type = other DNA
aggaggtactaccgggac

SEQ ID NO: 9674 - DNA, 18 bp, synthetic construct
  source 1..18: mol_type = other DNA
acggagggcacttcgaca

SEQ ID NO: 9675 - DNA, 18 bp, synthetic construct
  source 1..18: mol_type = other DNA
agacccacccccagtgta

SEQ ID NO: 9676 - DNA, 19 bp, synthetic construct
  source 1..19: mol_type = other DNA
aggagaaagaccgggtccc

SEQ ID NO: 9677 - DNA, 21 bp, synthetic construct
  source 1..21: mol_type = other DNA
acgactgaagggtcagggtac

SEQ ID NO: 9678 - DNA, 18 bp, synthetic construct
  source 1..18: mol_type = other DNA
aggtcgcacctctaccac

SEQ ID NO: 9679 - DNA, 20 bp, synthetic construct
  source 1..20: mol_type = other DNA
agcagtgtccgacacgtcta

SEQ ID NO: 9680 - DNA, 20 bp, synthetic construct
  source 1..20: mol_type = other DNA
acccacgcactccccaagac

SEQ ID NO: 9681 - DNA, 20 bp, synthetic construct
  source 1..20: mol_type = other DNA
acaggaggtgagccatcgcc

SEQ ID NO: 9682 - DNA, 21 bp, synthetic construct
  source 1..21: mol_type = other DNA
aaccaaaccctccgcaaccac

SEQ ID NO: 9683 - DNA, 21 bp, synthetic construct
  source 1..21: mol_type = other DNA
aacgtcccaatgcaatccgtg

SEQ ID NO: 9684 - DNA, 18 bp, synthetic construct
  source 1..18: mol_type = other DNA
agagggaccttgggagcg

SEQ ID NO: 9685 - DNA, 18 bp, synthetic construct
  source 1..18: mol_type = other DNA
aggctagggaccacgagg

SEQ ID NO: 9686 - DNA, 20 bp, synthetic construct
  source 1..20: mol_type = other DNA
agaggtcggaggacccaaag

SEQ ID NO: 9687 - DNA, 19 bp, synthetic construct
  source 1..19: mol_type = other DNA
agacatccgtccagccgag

SEQ ID NO: 9688 - DNA, 20 bp, synthetic construct
  source 1..20: mol_type = other DNA
accgaagtgaggtcctcgag

SEQ ID NO: 9689 - DNA, 18 bp, synthetic construct
  source 1..18: mol_type = other DNA
acgacacccgcaagacct

SEQ ID NO: 9690 - DNA, 18 bp, synthetic construct
  source 1..18: mol_type = other DNA
aaccactacccaccgcac

SEQ ID NO: 9691 - DNA, 20 bp, synthetic construct
  source 1..20: mol_type = other DNA
acgggcgacctggagcatga

SEQ ID NO: 9692 - DNA, 21 bp, synthetic construct
  source 1..21: mol_type = other DNA
agccactactacctgagcgtc

SEQ ID NO: 9693 - DNA, 20 bp, synthetic construct
  source 1..20: mol_type = other DNA
aggaccatcggtccaagtcg

SEQ ID NO: 9694 - DNA, 20 bp, synthetic construct
  source 1..20: mol_type = other DNA
acacaggtgttaccggagtg

SEQ ID NO: 9695 - DNA, 18 bp, synthetic construct
  source 1..18: mol_type = other DNA
aggctactagaggggacg

SEQ ID NO: 9696 - DNA, 18 bp, synthetic construct
  source 1..18: mol_type = other DNA
acggaacggacaacccaa

SEQ ID NO: 9697 - DNA, 20 bp, synthetic construct
  source 1..20: mol_type = other DNA
aggccaacaagtacctcaac

SEQ ID NO: 9698 - DNA, 19 bp, synthetic construct
  source 1..19: mol_type = other DNA
acctgcatgccgagaaacc

SEQ ID NO: 9699 - DNA, 20 bp, synthetic construct
  source 1..20: mol_type = other DNA
aggtaagtcgaactcccagg

SEQ ID NO: 9700 - DNA, 19 bp, synthetic construct
  source 1..19: mol_type = other DNA
aaggacttgggtacccagg

SEQ ID NO: 9701 - DNA, 18 bp, synthetic construct
  source 1..18: mol_type = other DNA
accgctacccgggaccga

SEQ ID NO: 9702 - DNA, 20 bp, synthetic construct
  source 1..20: mol_type = other DNA
aacccctccctgaccactcg

SEQ ID NO: 9703 - DNA, 20 bp, synthetic construct
  source 1..20: mol_type = other DNA
accggttacttccgcatcta

SEQ ID NO: 9704 - DNA, 20 bp, synthetic construct
  source 1..20: mol_type = other DNA
accacgtcaggagtctcgac

SEQ ID NO: 9705 - DNA, 20 bp, synthetic construct
  source 1..20: mol_type = other DNA
agacggagtgactgcaaccg

SEQ ID NO: 9706 - DNA, 20 bp, synthetic construct
  source 1..20: mol_type = other DNA
acgcaaagacgaaccaagag

SEQ ID NO: 9707 - DNA, 21 bp, synthetic construct
  source 1..21: mol_type = other DNA
agtccatacgctaccggagac

SEQ ID NO: 9708 - DNA, 17 bp, synthetic construct
  source 1..17: mol_type = other DNA
agggtcaacccggcagg

SEQ ID NO: 9709 - DNA, 19 bp, synthetic construct
  source 1..19: mol_type = other DNA
acgacagacctgaagcccc

SEQ ID NO: 9710 - DNA, 18 bp, synthetic construct
  source 1..18: mol_type = other DNA
acagtaccgtacaccgtc

SEQ ID NO: 9711 - DNA, 20 bp, synthetic construct
  source 1..20: mol_type = other DNA
agtcggagccagaacgtccg

SEQ ID NO: 9712 - DNA, 19 bp, synthetic construct
  source 1..19: mol_type = other DNA
agaccaagtccctcgtcgg

SEQ ID NO: 9713 - DNA, 18 bp, synthetic construct
  source 1..18: mol_type = other DNA
accgaaggggtgtatccg

SEQ ID NO: 9714 - DNA, 20 bp, synthetic construct
  source 1..20: mol_type = other DNA
agcgaacagactgtcccttg

SEQ ID NO: 9715 - DNA, 18 bp, synthetic construct
  source 1..18: mol_type = other DNA
acaccccacgggactgta

SEQ ID NO: 9716 - DNA, 18 bp, synthetic construct
  source 1..18: mol_type = other DNA
acacggaggacgtacctg

SEQ ID NO: 9717 - DNA, 18 bp, synthetic construct
  source 1..18: mol_type = other DNA
actccgcacaaccggtct

SEQ ID NO: 9718 - DNA, 21 bp, synthetic construct
  source 1..21: mol_type = other DNA
aacacccggttggacctcaaa

SEQ ID NO: 9719 - DNA, 19 bp, synthetic construct
  source 1..19: mol_type = other DNA
aacccccatctctcgaccg

SEQ ID NO: 9720 - DNA, 18 bp, synthetic construct
  source 1..18: mol_type = other DNA
agcacaccggtctagagc

SEQ ID NO: 9721 - DNA, 18 bp, synthetic construct
  source 1..18: mol_type = other DNA
aggggaggtaccgtccac

SEQ ID NO: 9722 - DNA, 18 bp, synthetic construct
  source 1..18: mol_type = other DNA
agccaggttccgaggtag

SEQ ID NO: 9723 - DNA, 18 bp, synthetic construct
  source 1..18: mol_type = other DNA
agagctctaggcacgtcg

SEQ ID NO: 9724 - DNA, 20 bp, synthetic construct
  source 1..20: mol_type = other DNA
agctacctacaggcgtggag

SEQ ID NO: 9725 - DNA, 20 bp, synthetic construct
  source 1..20: mol_type = other DNA
acaggaaaggatggggggct

SEQ ID NO: 9726 - DNA, 18 bp, synthetic construct
  source 1..18: mol_type = other DNA
acggcaccgtacaaccac

SEQ ID NO: 9727 - DNA, 18 bp, synthetic construct
  source 1..18: mol_type = other DNA
acagaactccgcgaaccc

SEQ ID NO: 9728 - DNA, 20 bp, synthetic construct
  source 1..20: mol_type = other DNA
aaggacgatccgttggactc

SEQ ID NO: 9729 - DNA, 18 bp, synthetic construct
  source 1..18: mol_type = other DNA
acaggtcccacgaaggga

SEQ ID NO: 9730 - DNA, 18 bp, synthetic construct
  source 1..18: mol_type = other DNA
accggaacaaccacgtcc

SEQ ID NO: 9731 - DNA, 19 bp, synthetic construct
  source 1..19: mol_type = other DNA
aggaggactcggtgacgtt

SEQ ID NO: 9732 - DNA, 18 bp, synthetic construct
  source 1..18: mol_type = other DNA
aacgaccgcttccagtcc

SEQ ID NO: 9733 - DNA, 20 bp, synthetic construct
  source 1..20: mol_type = other DNA
aggggcatgtacaagaggga

SEQ ID NO: 9734 - DNA, 18 bp, synthetic construct
  source 1..18: mol_type = other DNA
acgacacgaagggacgtc

SEQ ID NO: 9735 - DNA, 19 bp, synthetic construct
  source 1..19: mol_type = other DNA
accaccggtacagaaccag

SEQ ID NO: 9736 - DNA, 19 bp, synthetic construct
  source 1..19: mol_type = other DNA
agacaggccagaatcgcgg

SEQ ID NO: 9737 - DNA, 19 bp, synthetic construct
  source 1..19: mol_type = other DNA
accacctcaaacctcgtcc

SEQ ID NO: 9738 - DNA, 18 bp, synthetic construct
  source 1..18: mol_type = other DNA
aacccactcctcgcacac

SEQ ID NO: 9739 - DNA, 22 bp, synthetic construct
  source 1..22: mol_type = other DNA
aacggtgaagagctgcgacgaa

SEQ ID NO: 9740 - DNA, 18 bp, synthetic construct
  source 1..18: mol_type = other DNA
acgaggggagcgaagact

SEQ ID NO: 9741 - DNA, 18 bp, synthetic construct
  source 1..18: mol_type = other DNA
acccggactcctgacact

SEQ ID NO: 9742 - DNA, 18 bp, synthetic construct
  source 1..18: mol_type = other DNA
aggaggaccccctacccg

SEQ ID NO: 9743 - DNA, 18 bp, synthetic construct
  source 1..18: mol_type = other DNA
accgagccgactgagtac

SEQ ID NO: 9744 - DNA, 18 bp, synthetic construct
  source 1..18: mol_type = other DNA
aaccccgacttgaggacc

SEQ ID NO: 9745 - DNA, 19 bp, synthetic construct
  source 1..19: mol_type = other DNA
acaggcgtcaggaatcgcc

SEQ ID NO: 9746 - DNA, 20 bp, synthetic construct
  source 1..20: mol_type = other DNA
accgtccaagaggaagggtc

SEQ ID NO: 9747 - DNA, 18 bp, synthetic construct
  source 1..18: mol_type = other DNA
agaggagaggacgtgggg

SEQ ID NO: 9748 - DNA, 19 bp, synthetic construct
  source 1..19: mol_type = other DNA
agccccgacctcctcatcg

SEQ ID NO: 9749 - DNA, 20 bp, synthetic construct
  source 1..20: mol_type = other DNA
aacccctgaccgccgaggac

SEQ ID NO: 9750 - DNA, 21 bp, synthetic construct
  source 1..21: mol_type = other DNA
aggggagtagactcacgaaga

SEQ ID NO: 9751 - DNA, 20 bp, synthetic construct
  source 1..20: mol_type = other DNA
agacaaccctagagccccgc

SEQ ID NO: 9752 - DNA, 18 bp, synthetic construct
  source 1..18: mol_type = other DNA
agacagcttcccctggca

SEQ ID NO: 9753 - DNA, 18 bp, synthetic construct
  source 1..18: mol_type = other DNA
accgagacgttggagacg

SEQ ID NO: 9754 - DNA, 19 bp, synthetic construct
  source 1..19: mol_type = other DNA
aggaccagaactctgggcc

SEQ ID NO: 9755 - DNA, 21 bp, synthetic construct
  source 1..21: mol_type = other DNA
aaccgctaggagaaacccaac

SEQ ID NO: 9756 - DNA, 20 bp, synthetic construct
  source 1..20: mol_type = other DNA
aggcaataatcctcggccac

SEQ ID NO: 9757 - DNA, 21 bp, synthetic construct
  source 1..21: mol_type = other DNA
aggagacgtaccctaccgagt

SEQ ID NO: 9758 - DNA, 19 bp, synthetic construct
  source 1..19: mol_type = other DNA
aacgtcgttgacccgagtt

SEQ ID NO: 9759 - DNA, 18 bp, synthetic construct
  source 1..18: mol_type = other DNA
agcgacgggacctagaac

SEQ ID NO: 9760 - DNA, 22 bp, synthetic construct
  source 1..22: mol_type = other DNA
agagggttcaaaactcggtaag

SEQ ID NO: 9761 - DNA, 18 bp, synthetic construct
  source 1..18: mol_type = other DNA
acgaaccaccgaaccagt

SEQ ID NO: 9762 - DNA, 18 bp, synthetic construct
  source 1..18: mol_type = other DNA
acccccaaccgttcgtca

SEQ ID NO: 9763 - DNA, 18 bp, synthetic construct
  source 1..18: mol_type = other DNA
agcggtaggtgacgtgtc

SEQ ID NO: 9764 - DNA, 18 bp, synthetic construct
  source 1..18: mol_type = other DNA
aacccgacgtaccgagtg

SEQ ID NO: 9765 - DNA, 18 bp, synthetic construct
  source 1..18: mol_type = other DNA
aaggaccgtcgacaggct

SEQ ID NO: 9766 - DNA, 19 bp, synthetic construct
  source 1..19: mol_type = other DNA
acgacgacatgcacgagct

SEQ ID NO: 9767 - DNA, 23 bp, synthetic construct
  source 1..23: mol_type = other DNA
acagggacatgacctggtaaaac

SEQ ID NO: 9768 - DNA, 18 bp, synthetic construct
  source 1..18: mol_type = other DNA
accagcttgaccgggtac

SEQ ID NO: 9769 - DNA, 20 bp, synthetic construct
  source 1..20: mol_type = other DNA
agccacatcgggtggaagtc

SEQ ID NO: 9770 - DNA, 18 bp, synthetic construct
  source 1..18: mol_type = other DNA
acaggcagcaaatcggcg

SEQ ID NO: 9771 - DNA, 20 bp, synthetic construct
  source 1..20: mol_type = other DNA
acgggaacatctgacacggt

SEQ ID NO: 9772 - DNA, 20 bp, synthetic construct
  source 1..20: mol_type = other DNA
acggaagaggaggccaagta

SEQ ID NO: 9773 - DNA, 21 bp, synthetic construct
  source 1..21: mol_type = other DNA
acacagactcgagaacccggt

SEQ ID NO: 9774 - DNA, 22 bp, synthetic construct
  source 1..22: mol_type = other DNA
acacaaggtacaggcacccgta

SEQ ID NO: 9775 - DNA, 18 bp, synthetic construct
  source 1..18: mol_type = other DNA
agccacgacctgcaaagg

SEQ ID NO: 9776 - DNA, 20 bp, synthetic construct
  source 1..20: mol_type = other DNA
agaccccacgactactcaca

SEQ ID NO: 9777 - DNA, 21 bp, synthetic construct
  source 1..21: mol_type = other DNA
acagggtcacagaagggcaca

SEQ ID NO: 9778 - DNA, 18 bp, synthetic construct
  source 1..18: mol_type = other DNA
aagggtgacgtgccacct

SEQ ID NO: 9779 - DNA, 18 bp, synthetic construct
  source 1..18: mol_type = other DNA
acggctagagacgtaggc

SEQ ID NO: 9780 - DNA, 18 bp, synthetic construct
  source 1..18: mol_type = other DNA
agacggcaccggtccacg

SEQ ID NO: 9781 - DNA, 25 bp, synthetic construct
  source 1..25: mol_type = other DNA
accgtagggaatcaaacacaggcag

SEQ ID NO: 9782 - DNA, 20 bp, synthetic construct
  source 1..20: mol_type = other DNA
agcagccactccagtgtgag

SEQ ID NO: 9783 - DNA, 18 bp, synthetic construct
  source 1..18: mol_type = other DNA
accgcaaacgtagggacg

SEQ ID NO: 9784 - DNA, 18 bp, synthetic construct
  source 1..18: mol_type = other DNA
aggaccaccgtttcgggt

SEQ ID NO: 9785 - DNA, 21 bp, synthetic construct
  source 1..21: mol_type = other DNA
actgacaaccagtcgaaggtc

SEQ ID NO: 9786 - DNA, 18 bp, synthetic construct
  source 1..18: mol_type = other DNA
agcaagtcccttcgaccc

SEQ ID NO: 9787 - DNA, 18 bp, synthetic construct
  source 1..18: mol_type = other DNA
aacgccacgacaacggag

SEQ ID NO: 9788 - DNA, 18 bp, synthetic construct
  source 1..18: mol_type = other DNA
aaggggccggaagggagg

SEQ ID NO: 9789 - DNA, 18 bp, synthetic construct
  source 1..18: mol_type = other DNA
agtgccgacggaactccc

SEQ ID NO: 9790 - DNA, 18 bp, synthetic construct
  source 1..18: mol_type = other DNA
accggagggtgaacggtg

SEQ ID NO: 9791 - DNA, 21 bp, synthetic construct
  source 1..21: mol_type = other DNA
acgtccggaaggttcaagact

SEQ ID NO: 9792 - DNA, 19 bp, synthetic construct
  source 1..19: mol_type = other DNA
accgtcgccatcacctccg

SEQ ID NO: 9793 - DNA, 18 bp, synthetic construct
  source 1..18: mol_type = other DNA
agccggagccaccttaag

SEQ ID NO: 9794 - DNA, 18 bp, synthetic construct
  source 1..18: mol_type = other DNA
agcgacgacacgtagagg

SEQ ID NO: 9795 - DNA, 19 bp, synthetic construct
  source 1..19: mol_type = other DNA
accacggatggtctcacgg

SEQ ID NO: 9796 - DNA, 18 bp, synthetic construct
  source 1..18: mol_type = other DNA
accggcagtaccacatcg

SEQ ID NO: 9797 - DNA, 18 bp, synthetic construct
  source 1..18: mol_type = other DNA
acgaccgtcgccaccaat

SEQ ID NO: 9798 - DNA, 21 bp, synthetic construct
  source 1..21: mol_type = other DNA
agcagaaaccccgtgtcgagt

SEQ ID NO: 9799 - DNA, 18 bp, synthetic construct
  source 1..18: mol_type = other DNA
aggacggtgccggtacgc

SEQ ID NO: 9800 - DNA, 18 bp, synthetic construct
  source 1..18: mol_type = other DNA
accgggaggtagtggtgg

SEQ ID NO: 9801 - DNA, 18 bp, synthetic construct
  source 1..18: mol_type = other DNA
acgggaaggtacagcagt

SEQ ID NO: 9802 - DNA, 18 bp, synthetic construct
  source 1..18: mol_type = other DNA
acacaaggacggagcgtc

SEQ ID NO: 9803 - DNA, 20 bp, synthetic construct
  source 1..20: mol_type = other DNA
accagtgtccgaacctactc

SEQ ID NO: 9804 - DNA, 20 bp, synthetic construct
  source 1..20: mol_type = other DNA
accagtgtccgaacctactc

SEQ ID NO: 9805 - DNA, 20 bp, synthetic construct
  source 1..20: mol_type = other DNA
acccgtaaccccgactacga

SEQ ID NO: 9806 - DNA, 18 bp, synthetic construct
  source 1..18: mol_type = other DNA
agtcaggcgtacggtcga

SEQ ID NO: 9807 - DNA, 21 bp, synthetic construct
  source 1..21: mol_type = other DNA
acctgaagatcgacgtggccc

SEQ ID NO: 9808 - DNA, 18 bp, synthetic construct
  source 1..18: mol_type = other DNA
aggcagtgacaaccccgg

SEQ ID NO: 9809 - DNA, 20 bp, synthetic construct
  source 1..20: mol_type = other DNA
agggaggtagtggacaggag

SEQ ID NO: 9810 - DNA, 21 bp, synthetic construct
  source 1..21: mol_type = other DNA
aacaaccggagtgtcctcatc

SEQ ID NO: 9811 - DNA, 21 bp, synthetic construct
  source 1..21: mol_type = other DNA
acgacctacgaggtctagacc

SEQ ID NO: 9812 - DNA, 19 bp, synthetic construct
  source 1..19: mol_type = other DNA
accccagtctccggtgacg

SEQ ID NO: 9813 - DNA, 20 bp, synthetic construct
  source 1..20: mol_type = other DNA
acccgtgacgagaggtggac

SEQ ID NO: 9814 - DNA, 20 bp, synthetic construct
  source 1..20: mol_type = other DNA
agagcgacgaggaagacgaa

SEQ ID NO: 9815 - DNA, 19 bp, synthetic construct
  source 1..19: mol_type = other DNA
aacccagtatcctcggggg

SEQ ID NO: 9816 - DNA, 18 bp, synthetic construct
  source 1..18: mol_type = other DNA
acgaaaccgacctgctcg

SEQ ID NO: 9817 - DNA, 18 bp, synthetic construct
  source 1..18: mol_type = other DNA
agaggggcactcgggtcc

SEQ ID NO: 9818 - DNA, 19 bp, synthetic construct
  source 1..19: mol_type = other DNA
accccctcatgaccaggtc

SEQ ID NO: 9819 - DNA, 19 bp, synthetic construct
  source 1..19: mol_type = other DNA
acccccacagacggcaact

SEQ ID NO: 9820 - DNA, 18 bp, synthetic construct
  source 1..18: mol_type = other DNA
agcacacacgtcaaccgc

SEQ ID NO: 9821 - DNA, 20 bp, synthetic construct
  source 1..20: mol_type = other DNA
accacacacatgtgggccag

SEQ ID NO: 9822 - DNA, 18 bp, synthetic construct
  source 1..18: mol_type = other DNA
accacaaccgcggttccg

SEQ ID NO: 9823 - DNA, 24 bp, synthetic construct
  source 1..24: mol_type = other DNA
agaggtcgacacggtaatatcaat

SEQ ID NO: 9824 - DNA, 20 bp, synthetic construct
  source 1..20: mol_type = other DNA
aggtgtaggacggccaccag

SEQ ID NO: 9825 - DNA, 20 bp, synthetic construct
  source 1..20: mol_type = other DNA
aaggacgacggggccaacat

SEQ ID NO: 9826 - DNA, 19 bp, synthetic construct
  source 1..19: mol_type = other DNA
agacggtagggtcagtcct

SEQ ID NO: 9827 - DNA, 19 bp, synthetic construct
  source 1..19: mol_type = other DNA
accaatgtccccacggtct

SEQ ID NO: 9828 - DNA, 18 bp, synthetic construct
  source 1..18: mol_type = other DNA
aacggctacgaagacgct

SEQ ID NO: 9829 - DNA, 18 bp, synthetic construct
  source 1..18: mol_type = other DNA
agggtgactcagggctcg

SEQ ID NO: 9830 - DNA, 18 bp, synthetic construct
  source 1..18: mol_type = other DNA
aggaccgggtggaacaac

SEQ ID NO: 9831 - DNA, 22 bp, synthetic construct
  source 1..22: mol_type = other DNA
aggacctgtcccgataaaggag

SEQ ID NO: 9832 - DNA, 21 bp, synthetic construct
  source 1..21: mol_type = other DNA
acctctaccggacgtgcacct

SEQ ID NO: 9833 - DNA, 18 bp, synthetic construct
  source 1..18: mol_type = other DNA
acaccgacgaacctcgta

SEQ ID NO: 9834 - DNA, 20 bp, synthetic construct
  source 1..20: mol_type = other DNA
agggagccgacatcaacgac

SEQ ID NO: 9835 - DNA, 18 bp, synthetic construct
  source 1..18: mol_type = other DNA
acccccaggggaaagtcc

SEQ ID NO: 9836 - DNA, 18 bp, synthetic construct
  source 1..18: mol_type = other DNA
acgacggcgggggacttg

SEQ ID NO: 9837 - DNA, 18 bp, synthetic construct
  source 1..18: mol_type = other DNA
accaacaacgggtcgctc

SEQ ID NO: 9838 - DNA, 18 bp, synthetic construct
  source 1..18: mol_type = other DNA
acgcctaaccaccgcatc

SEQ ID NO: 9839 - DNA, 20 bp, synthetic construct
  source 1..20: mol_type = other DNA
aagaaggtccaccgtcctac

SEQ ID NO: 9840 - DNA, 21 bp, synthetic construct
  source 1..21: mol_type = other DNA
acgaacacctagaaccaccgt

SEQ ID NO: 9841 - DNA, 21 bp, synthetic construct
  source 1..21: mol_type = other DNA
agagaaactcggtctgccacg

SEQ ID NO: 9842 - DNA, 21 bp, synthetic construct
  source 1..21: mol_type = other DNA
aacggcccctgacttcacaga

SEQ ID NO: 9843 - DNA, 21 bp, synthetic construct
  source 1..21: mol_type = other DNA
agacggagaaccacgccaggt

SEQ ID NO: 9844 - DNA, 20 bp, synthetic construct
  source 1..20: mol_type = other DNA
agtcgaaggtcggtgaccta

SEQ ID NO: 9845 - DNA, 20 bp, synthetic construct
  source 1..20: mol_type = other DNA
acagcgggtggtgtgggaag

SEQ ID NO: 9846 - DNA, 18 bp, synthetic construct
  source 1..18: mol_type = other DNA
aggtccacgacgctcaag

SEQ ID NO: 9847 - DNA, 21 bp, synthetic construct
  source 1..21: mol_type = other DNA
agagccactacatcagcccca

SEQ ID NO: 9848 - DNA, 18 bp, synthetic construct
  source 1..18: mol_type = other DNA
accaaaagtgacgcccct

SEQ ID NO: 9849 - DNA, 18 bp, synthetic construct
  source 1..18: mol_type = other DNA
agctgaaccctaccccca

SEQ ID NO: 9850 - DNA, 21 bp, synthetic construct
  source 1..21: mol_type = other DNA
agaggaaaggctaactaaccg

SEQ ID NO: 9851 - DNA, 18 bp, synthetic construct
  source 1..18: mol_type = other DNA
aacccgttccagagggct

SEQ ID NO: 9852 - DNA, 18 bp, synthetic construct
  source 1..18: mol_type = other DNA
agccccaccagtctctcg

SEQ ID NO: 9853 - DNA, 22 bp, synthetic construct
  source 1..22: mol_type = other DNA
agaacacacctaaggtgcagtg

SEQ ID NO: 9854 - DNA, 18 bp, synthetic construct
  source 1..18: mol_type = other DNA
acgtacaccctcccgagt

SEQ ID NO: 9855 - DNA, 20 bp, synthetic construct
  source 1..20: mol_type = other DNA
acggaaaatccaccaccgta

SEQ ID NO: 9856 - DNA, 18 bp, synthetic construct
  source 1..18: mol_type = other DNA
acgaggacacggagggtc

SEQ ID NO: 9857 - DNA, 20 bp, synthetic construct
  source 1..20: mol_type = other DNA
accccttcaggaggtcactc

SEQ ID NO: 9858 - DNA, 20 bp, synthetic construct
  source 1..20: mol_type = other DNA
acagcttcaatggcggcggc

SEQ ID NO: 9859 - DNA, 19 bp, synthetic construct
  source 1..19: mol_type = other DNA
aacccgtgcggacctcagg

SEQ ID NO: 9860 - DNA, 18 bp, synthetic construct
  source 1..18: mol_type = other DNA
aaccaggctgacgctgcc

SEQ ID NO: 9861 - DNA, 18 bp, synthetic construct
  source 1..18: mol_type = other DNA
aacccctgtccctaccga

SEQ ID NO: 9862 - DNA, 18 bp, synthetic construct
  source 1..18: mol_type = other DNA
acgaggacctcaagggct

SEQ ID NO: 9863 - DNA, 18 bp, synthetic construct
  source 1..18: mol_type = other DNA
acccccagtactgacacg

SEQ ID NO: 9864 - DNA, 21 bp, synthetic construct
  source 1..21: mol_type = other DNA
aacagcactcgagacacttcg

SEQ ID NO: 9865 - DNA, 20 bp, synthetic construct
  source 1..20: mol_type = other DNA
agagaccacaagtcccgagt

SEQ ID NO: 9866 - DNA, 18 bp, synthetic construct
  source 1..18: mol_type = other DNA
acgaggaaccgaaggacg

SEQ ID NO: 9867 - DNA, 21 bp, synthetic construct
  source 1..21: mol_type = other DNA
accgggttacaccgatggagg

SEQ ID NO: 9868 - DNA, 18 bp, synthetic construct
  source 1..18: mol_type = other DNA
acgacccgtcaaagaggc

SEQ ID NO: 9869 - DNA, 18 bp, synthetic construct
  source 1..18: mol_type = other DNA
aaccgctagagggtgagc

SEQ ID NO: 9870 - DNA, 19 bp, synthetic construct
  source 1..19: mol_type = other DNA
acgggaacctcgtggggtg

SEQ ID NO: 9871 - DNA, 20 bp, synthetic construct
  source 1..20: mol_type = other DNA
acgtccggcgacccgattca

SEQ ID NO: 9872 - DNA, 18 bp, synthetic construct
  source 1..18: mol_type = other DNA
agctcccagacgtcgacc

SEQ ID NO: 9873 - DNA, 18 bp, synthetic construct
  source 1..18: mol_type = other DNA
agaggtcgcacggacttc

SEQ ID NO: 9874 - DNA, 18 bp, synthetic construct
  source 1..18: mol_type = other DNA
acggtcgacgacaccaac

SEQ ID NO: 9875 - DNA, 19 bp, synthetic construct
  source 1..19: mol_type = other DNA
acgggtctaactcacggac

SEQ ID NO: 9876 - DNA, 19 bp, synthetic construct
  source 1..19: mol_type = other DNA
accgcacacagagtgtggg

SEQ ID NO: 9877 - DNA, 22 bp, synthetic construct
  source 1..22: mol_type = other DNA
agccggtgttcgccaacaaaat

SEQ ID NO: 9878 - DNA, 18 bp, synthetic construct
  source 1..18: mol_type = other DNA
aggcacccttacgaggga

SEQ ID NO: 9879 - DNA, 18 bp, synthetic construct
  source 1..18: mol_type = other DNA
agcacgggaggagccacc

SEQ ID NO: 9880 - DNA, 20 bp, synthetic construct
  source 1..20: mol_type = other DNA
accgcatcatcatgggccgt

SEQ ID NO: 9881 - DNA, 20 bp, synthetic construct
  source 1..20: mol_type = other DNA
agtgaccaagactcctcacc

SEQ ID NO: 9882 - DNA, 22 bp, synthetic construct
  source 1..22: mol_type = other DNA
aaccggagtgagagaaggagta

SEQ ID NO: 9883 - DNA, 21 bp, synthetic construct
  source 1..21: mol_type = other DNA
agcacgaacccaaaccggcgt

SEQ ID NO: 9884 - DNA, 21 bp, synthetic construct
  source 1..21: mol_type = other DNA
accatctgaaaggccaacgtc

SEQ ID NO: 9885 - DNA, 19 bp, synthetic construct
  source 1..19: mol_type = other DNA
acagagaaggtcgggcact

SEQ ID NO: 9886 - DNA, 18 bp, synthetic construct
  source 1..18: mol_type = other DNA
accacgctgacaacgtcg

SEQ ID NO: 9887 - DNA, 25 bp, synthetic construct
  source 1..25: mol_type = other DNA
aactgtcggaacggaacaaggagta

SEQ ID NO: 9888 - DNA, 19 bp, synthetic construct
  source 1..19: mol_type = other DNA
accgaccactccagtgtcg

SEQ ID NO: 9889 - DNA, 20 bp, synthetic construct
  source 1..20: mol_type = other DNA
acgcacacctgtcccgaaac

SEQ ID NO: 9890 - DNA, 18 bp, synthetic construct
  source 1..18: mol_type = other DNA
acagccaacagagccgtc

SEQ ID NO: 9891 - DNA, 18 bp, synthetic construct
  source 1..18: mol_type = other DNA
aaccggactcgacacgga

SEQ ID NO: 9892 - DNA, 22 bp, synthetic construct
  source 1..22: mol_type = other DNA
accgacgtatacacagggcaaa

SEQ ID NO: 9893 - DNA, 21 bp, synthetic construct
  source 1..21: mol_type = other DNA
acgtgctcagagaaggtggag

SEQ ID NO: 9894 - DNA, 22 bp, synthetic construct
  source 1..22: mol_type = other DNA
aagcgtgaaagctagaaggacg

SEQ ID NO: 9895 - DNA, 20 bp, synthetic construct
  source 1..20: mol_type = other DNA
accgggggctactagaggag

SEQ ID NO: 9896 - DNA, 20 bp, synthetic construct
  source 1..20: mol_type = other DNA
agccggccactggaaggact

SEQ ID NO: 9897 - DNA, 22 bp, synthetic construct
  source 1..22: mol_type = other DNA
agaaggacgcagaccaagagaa

SEQ ID NO: 9898 - DNA, 18 bp, synthetic construct
  source 1..18: mol_type = other DNA
acagccgcccatgcaacc

SEQ ID NO: 9899 - DNA, 20 bp, synthetic construct
  source 1..20: mol_type = other DNA
aggctatccactgcacccaa

SEQ ID NO: 9900 - DNA, 19 bp, synthetic construct
  source 1..19: mol_type = other DNA
aggactcgtggtgcaacgg

SEQ ID NO: 9901 - DNA, 21 bp, synthetic construct
  source 1..21: mol_type = other DNA
aagccctgagaaggcgaacgt

SEQ ID NO: 9902 - DNA, 18 bp, synthetic construct
  source 1..18: mol_type = other DNA
agaggagccagaggcccc

SEQ ID NO: 9903 - DNA, 19 bp, synthetic construct
  source 1..19: mol_type = other DNA
aacccaccgtagtaccact

SEQ ID NO: 9904 - DNA, 19 bp, synthetic construct
  source 1..19: mol_type = other DNA
acctccgtgggtgggaggg

SEQ ID NO: 9905 - DNA, 21 bp, synthetic construct
  source 1..21: mol_type = other DNA
aagacgacgagaggttaggtc

SEQ ID NO: 9906 - DNA, 23 bp, synthetic construct
  source 1..23: mol_type = other DNA
acgaccaggagactgaacaaaag

SEQ ID NO: 9907 - DNA, 20 bp, synthetic construct
  source 1..20: mol_type = other DNA
acagacgaggaggaccgaag

SEQ ID NO: 9908 - DNA, 20 bp, synthetic construct
  source 1..20: mol_type = other DNA
accacctgtacccccacccc

SEQ ID NO: 9909 - DNA, 18 bp, synthetic construct
  source 1..18: mol_type = other DNA
acagcgacgtgcgtcgga

SEQ ID NO: 9910 - DNA, 20 bp, synthetic construct
  source 1..20: mol_type = other DNA
acgagaacaggtcttccgtg

SEQ ID NO: 9911 - DNA, 19 bp, synthetic construct
  source 1..19: mol_type = other DNA
agaggaggacgggtaagtc

SEQ ID NO: 9912 - DNA, 20 bp, synthetic construct
  source 1..20: mol_type = other DNA
aaccgagaacccggagggtc

SEQ ID NO: 9913 - DNA, 20 bp, synthetic construct
  source 1..20: mol_type = other DNA
aggtccgaccacacgaggtg

SEQ ID NO: 9914 - DNA, 20 bp, synthetic construct
  source 1..20: mol_type = other DNA
acgaggtggaacgtcagtat

SEQ ID NO: 9915 - DNA, 25 bp, synthetic construct
  source 1..25: mol_type = other DNA
agaggacatctaccactacgtggaa

SEQ ID NO: 9916 - DNA, 18 bp, synthetic construct
  source 1..18: mol_type = other DNA
accccgagacctccgacc

SEQ ID NO: 9917 - DNA, 20 bp, synthetic construct
  source 1..20: mol_type = other DNA
aggtcaggagctacgaggcg

SEQ ID NO: 9918 - DNA, 20 bp, synthetic construct
  source 1..20: mol_type = other DNA
actcctgcaacccgagagag

SEQ ID NO: 9919 - DNA, 21 bp, synthetic construct
  source 1..21: mol_type = other DNA
aaggtgacactctcccgaaca

SEQ ID NO: 9920 - DNA, 21 bp, synthetic construct
  source 1..21: mol_type = other DNA
aagacttagtccggacacctg

SEQ ID NO: 9921 - DNA, 20 bp, synthetic construct
  source 1..20: mol_type = other DNA
agacacgccacagggaccgc

SEQ ID NO: 9922 - DNA, 20 bp, synthetic construct
  source 1..20: mol_type = other DNA
aaggagtcccggtgagccag

SEQ ID NO: 9923 - DNA, 19 bp, synthetic construct
  source 1..19: mol_type = other DNA
agaccctcagaccaggggg

SEQ ID NO: 9924 - DNA, 19 bp, synthetic construct
  source 1..19: mol_type = other DNA
agagaaccaccgaggctcg

SEQ ID NO: 9925 - DNA, 21 bp, synthetic construct
  source 1..21: mol_type = other DNA
acgtgcaggaaactaccctct

SEQ ID NO: 9926 - DNA, 19 bp, synthetic construct
  source 1..19: mol_type = other DNA
acgtaaccagaaccagtcg

SEQ ID NO: 9927 - DNA, 18 bp, synthetic construct
  source 1..18: mol_type = other DNA
agacaggtgcaccgaacc

SEQ ID NO: 9928 - DNA, 22 bp, synthetic construct
  source 1..22: mol_type = other DNA
acgaaggtaacgagacgaagtc

SEQ ID NO: 9929 - DNA, 20 bp, synthetic construct
  source 1..20: mol_type = other DNA
agggaccctgagcgaagacg

SEQ ID NO: 9930 - DNA, 18 bp, synthetic construct
  source 1..18: mol_type = other DNA
aacgcaaggtcccgtgac

SEQ ID NO: 9931 - DNA, 18 bp, synthetic construct
  source 1..18: mol_type = other DNA
aacggtggaaaaggccac

SEQ ID NO: 9932 - DNA, 18 bp, synthetic construct
  source 1..18: mol_type = other DNA
acgaacaccacatggggc

SEQ ID NO: 9933 - DNA, 21 bp, synthetic construct
  source 1..21: mol_type = other DNA
agcatgagggggagcataagt

SEQ ID NO: 9934 - DNA, 18 bp, synthetic construct
  source 1..18: mol_type = other DNA
agggcccagaccaagaac

SEQ ID NO: 9935 - DNA, 20 bp, synthetic construct
  source 1..20: mol_type = other DNA
aagccccgactcacaaacac

SEQ ID NO: 9936 - DNA, 18 bp, synthetic construct
  source 1..18: mol_type = other DNA
aacggagcactcgacctg

SEQ ID NO: 9937 - DNA, 20 bp, synthetic construct
  source 1..20: mol_type = other DNA
agaccactgaacccgtccat

SEQ ID NO: 9938 - DNA, 22 bp, synthetic construct
  source 1..22: mol_type = other DNA
agcgtctcataaacggggggaa

SEQ ID NO: 9939 - DNA, 18 bp, synthetic construct
  source 1..18: mol_type = other DNA
agccaaggccatcgccga

SEQ ID NO: 9940 - DNA, 19 bp, synthetic construct
  source 1..19: mol_type = other DNA
atcgacccccaacggaaag

SEQ ID NO: 9941 - DNA, 18 bp, synthetic construct
  source 1..18: mol_type = other DNA
acccgcaaccgcacgtac

SEQ ID NO: 9942 - DNA, 18 bp, synthetic construct
  source 1..18: mol_type = other DNA
aaggtggacgccgacgcc

SEQ ID NO: 9943 - DNA, 18 bp, synthetic construct
  source 1..18: mol_type = other DNA
aggaggagcctgaggccc

SEQ ID NO: 9944 - DNA, 21 bp, synthetic construct
  source 1..21: mol_type = other DNA
acgcaacctgtaagttcagtc

SEQ ID NO: 9945 - DNA, 23 bp, synthetic construct
  source 1..23: mol_type = other DNA
agaaggaagacgcactcataaaa

SEQ ID NO: 9946 - DNA, 19 bp, synthetic construct
  source 1..19: mol_type = other DNA
accgacctccaggcccatc

SEQ ID NO: 9947 - DNA, 18 bp, synthetic construct
  source 1..18: mol_type = other DNA
agaggggcaacaaggacc

SEQ ID NO: 9948 - DNA, 18 bp, synthetic construct
  source 1..18: mol_type = other DNA
aggagttgctacggtgcc

SEQ ID NO: 9949 - DNA, 20 bp, synthetic construct
  source 1..20: mol_type = other DNA
aacacgtagacgggcagcag

SEQ ID NO: 9950 - DNA, 18 bp, synthetic construct
  source 1..18: mol_type = other DNA
acctcccccaccttgaac

SEQ ID NO: 9951 - DNA, 18 bp, synthetic construct
  source 1..18: mol_type = other DNA
acggcgacgagtcgtcag

SEQ ID NO: 9952 - DNA, 20 bp, synthetic construct
  source 1..20: mol_type = other DNA
aggcagacagagactcggag

SEQ ID NO: 9953 - DNA, 20 bp, synthetic construct
  source 1..20: mol_type = other DNA
acgaccacgccaactcttgg

SEQ ID NO: 9954 - DNA, 18 bp, synthetic construct
  source 1..18: mol_type = other DNA
aggagaccagcgaggtgg

SEQ ID NO: 9955 - DNA, 20 bp, synthetic construct
  source 1..20: mol_type = other DNA
aagggtccagtgacgtcgac

SEQ ID NO: 9956 - DNA, 20 bp, synthetic construct
  source 1..20: mol_type = other DNA
agtgaggtaaggggtcgaaa

SEQ ID NO: 9957 - DNA, 18 bp, synthetic construct
  source 1..18: mol_type = other DNA
aggaccaccggaaccgga

SEQ ID NO: 9958 - DNA, 18 bp, synthetic construct
  source 1..18: mol_type = other DNA
acaccggtcaacctcgtc

SEQ ID NO: 9959 - DNA, 18 bp, synthetic construct
  source 1..18: mol_type = other DNA
actcgaccgagggagccc

SEQ ID NO: 9960 - DNA, 20 bp, synthetic construct
  source 1..20: mol_type = other DNA
aagcgaagttacgggaacaa

SEQ ID NO: 9961 - DNA, 21 bp, synthetic construct
  source 1..21: mol_type = other DNA
agggtagtcgcaactacgtcg

SEQ ID NO: 9962 - DNA, 18 bp, synthetic construct
  source 1..18: mol_type = other DNA
agacatccgggtcccgct

SEQ ID NO: 9963 - DNA, 19 bp, synthetic construct
  source 1..19: mol_type = other DNA
agaggacgaagactgccgg

SEQ ID NO: 9964 - DNA, 18 bp, synthetic construct
  source 1..18: mol_type = other DNA
acgggagcgagaacggtg

SEQ ID NO: 9965 - DNA, 19 bp, synthetic construct
  source 1..19: mol_type = other DNA
agggccatcgcgtcacctc

SEQ ID NO: 9966 - DNA, 18 bp, synthetic construct
  source 1..18: mol_type = other DNA
accggaccctatagtcgg

SEQ ID NO: 9967 - DNA, 19 bp, synthetic construct
  source 1..19: mol_type = other DNA
aggaggcagaggacgttgc

SEQ ID NO: 9968 - DNA, 18 bp, synthetic construct
  source 1..18: mol_type = other DNA
acagtccaactacgcccc

SEQ ID NO: 9969 - DNA, 19 bp, synthetic construct
  source 1..19: mol_type = other DNA
aaccgaggagttccagggc

SEQ ID NO: 9970 - DNA, 21 bp, synthetic construct
  source 1..21: mol_type = other DNA
acactgacgaggcacttcagg

SEQ ID NO: 9971 - DNA, 18 bp, synthetic construct
  source 1..18: mol_type = other DNA
acaggtataggtccggcc

SEQ ID NO: 9972 - DNA, 20 bp, synthetic construct
  source 1..20: mol_type = other DNA
aagggaagtggggtgagtcg

SEQ ID NO: 9973 - DNA, 18 bp, synthetic construct
  source 1..18: mol_type = other DNA
accacggaaccctggaga

SEQ ID NO: 9974 - DNA, 19 bp, synthetic construct
  source 1..19: mol_type = other DNA
aggtggaacagaagggcac

SEQ ID NO: 9975 - DNA, 21 bp, synthetic construct
  source 1..21: mol_type = other DNA
accccacaatgtgaagtcctg

SEQ ID NO: 9976 - DNA, 20 bp, synthetic construct
  source 1..20: mol_type = other DNA
acaccagggtcagtcaggcc

SEQ ID NO: 9977 - DNA, 21 bp, synthetic construct
  source 1..21: mol_type = other DNA
agcatgacaactgcggacaac

SEQ ID NO: 9978 - DNA, 22 bp, synthetic construct
  source 1..22: mol_type = other DNA
aggagatggaggaggaggagga

SEQ ID NO: 9979 - DNA, 21 bp, synthetic construct
  source 1..21: mol_type = other DNA
agaggggtcacacagaaacga

SEQ ID NO: 9980 - DNA, 18 bp, synthetic construct
  source 1..18: mol_type = other DNA
acggacgtacccccacct

SEQ ID NO: 9981 - DNA, 18 bp, synthetic construct
  source 1..18: mol_type = other DNA
aggcgcagaggtgtcgcg

SEQ ID NO: 9982 - DNA, 21 bp, synthetic construct
  source 1..21: mol_type = other DNA
aggtagaggggactcgataat

SEQ ID NO: 9983 - DNA, 20 bp, synthetic construct
  source 1..20: mol_type = other DNA
aaccgcggaggaggaaccag

SEQ ID NO: 9984 - DNA, 18 bp, synthetic construct
  source 1..18: mol_type = other DNA
aggtggacggggtggacg

SEQ ID NO: 9985 - DNA, 18 bp, synthetic construct
  source 1..18: mol_type = other DNA
accgactgagcaactggc

SEQ ID NO: 9986 - DNA, 18 bp, synthetic construct
  source 1..18: mol_type = other DNA
acacgactccccactggg

SEQ ID NO: 9987 - DNA, 23 bp, synthetic construct
  source 1..23: mol_type = other DNA
agagagaaggacgcgaaaacgac

SEQ ID NO: 9988 - DNA, 18 bp, synthetic construct
  source 1..18: mol_type = other DNA
accgacgtggagcaacag

SEQ ID NO: 9989 - DNA, 21 bp, synthetic construct
  source 1..21: mol_type = other DNA
acacgcctaaccgactcaacc

SEQ ID NO: 9990 - DNA, 20 bp, synthetic construct
  source 1..20: mol_type = other DNA
acagaatggtaggggtggac

SEQ ID NO: 9991 - DNA, 21 bp, synthetic construct
  source 1..21: mol_type = other DNA
acccccaagtcagtccaagac

SEQ ID NO: 9992 - DNA, 21 bp, synthetic construct
  source 1..21: mol_type = other DNA
agggcacctaccccttgttcg

SEQ ID NO: 9993 - DNA, 18 bp, synthetic construct
  source 1..18: mol_type = other DNA
acacgagccccgttgaga

SEQ ID NO: 9994 - DNA, 18 bp, synthetic construct
  source 1..18: mol_type = other DNA
agcaaccgacgcaggtag

SEQ ID NO: 9995 - DNA, 18 bp, synthetic construct
  source 1..18: mol_type = other DNA
acacccctactaccggac

SEQ ID NO: 9996 - DNA, 21 bp, synthetic construct
  source 1..21: mol_type = other DNA
aagccatcatacgaccgaggc

SEQ ID NO: 9997 - DNA, 20 bp, synthetic construct
  source 1..20: mol_type = other DNA
accaccacgtcaactcaggg

SEQ ID NO: 9998 - DNA, 18 bp, synthetic construct
  source 1..18: mol_type = other DNA
acggacgtaaaccgtcgg

SEQ ID NO: 9999 - DNA, 18 bp, synthetic construct
  source 1..18: mol_type = other DNA
agggcgagtctgacgtac

SEQ ID NO: 10000 - DNA, 22 bp, synthetic construct
  source 1..22: mol_type = other DNA
accaggttggaggaggagaaac

SEQ ID NO: 10001 - DNA, 18 bp, synthetic construct
  source 1..18: mol_type = other DNA
aaccggtgcagtcggtag

SEQ ID NO: 10002 - DNA, 20 bp, synthetic construct
  source 1..20: mol_type = other DNA
agagggagacacccgtactc

SEQ ID NO: 10003 - DNA, 18 bp, synthetic construct
  source 1..18: mol_type = other DNA
aagccctgtggagacggt

SEQ ID NO: 10004 - DNA, 20 bp, synthetic construct
  source 1..20: mol_type = other DNA
accacaccgtgcatgagctc

SEQ ID NO: 10005 - DNA, 18 bp, synthetic construct
  source 1..18: mol_type = other DNA
accagggcgagtggaacg

SEQ ID NO: 10006 - DNA, 20 bp, synthetic construct
  source 1..20: mol_type = other DNA
acgactgtccgtccagggag

SEQ ID NO: 10007 - DNA, 22 bp, synthetic construct
  source 1..22: mol_type = other DNA
acagggctgaaagatggaacca

SEQ ID NO: 10008 - DNA, 18 bp, synthetic construct
  source 1..18: mol_type = other DNA
accggcaacatcgcgagt

SEQ ID NO: 10009 - DNA, 19 bp, synthetic construct
  source 1..19: mol_type = other DNA
agcagtacatcccgagggg

SEQ ID NO: 10010 - DNA, 19 bp, synthetic construct
  source 1..19: mol_type = other DNA
aacgggaagaccaggaggc

SEQ ID NO: 10011 - DNA, 18 bp, synthetic construct
  source 1..18: mol_type = other DNA
agcgacgtctagaccggt

SEQ ID NO: 10012 - DNA, 18 bp, synthetic construct
  source 1..18: mol_type = other DNA
aaggcgacgtcctcccta

SEQ ID NO: 10013 - DNA, 18 bp, synthetic construct
  source 1..18: mol_type = other DNA
agggccacagagagcgta

SEQ ID NO: 10014 - DNA, 18 bp, synthetic construct
  source 1..18: mol_type = other DNA
acgacccgacgacgactt

SEQ ID NO: 10015 - DNA, 18 bp, synthetic construct
  source 1..18: mol_type = other DNA
acgaccggagaccgaaga

SEQ ID NO: 10016 - DNA, 20 bp, synthetic construct
  source 1..20: mol_type = other DNA
agacccaggaacgtcaggtg

SEQ ID NO: 10017 - DNA, 19 bp, synthetic construct
  source 1..19: mol_type = other DNA
accggagtccgtggaacgc

SEQ ID NO: 10018 - DNA, 18 bp, synthetic construct
  source 1..18: mol_type = other DNA
aaggaccgtgaaccgtgg

SEQ ID NO: 10019 - DNA, 18 bp, synthetic construct
  source 1..18: mol_type = other DNA
aacggcatgaccagcgtc

SEQ ID NO: 10020 - DNA, 21 bp, synthetic construct
  source 1..21: mol_type = other DNA
aggggcgtagtgaagaacagt

SEQ ID NO: 10021 - DNA, 20 bp, synthetic construct
  source 1..20: mol_type = other DNA
agaggacgaggagtgtggac

SEQ ID NO: 10022 - DNA, 18 bp, synthetic construct
  source 1..18: mol_type = other DNA
aagctccgagaaggcccg

SEQ ID NO: 10023 - DNA, 18 bp, synthetic construct
  source 1..18: mol_type = other DNA
acagcaagccggtcgagc

SEQ ID NO: 10024 - DNA, 19 bp, synthetic construct
  source 1..19: mol_type = other DNA
acccagagactgacccgag

SEQ ID NO: 10025 - DNA, 20 bp, synthetic construct
  source 1..20: mol_type = other DNA
accacggcattgtcggagaa

SEQ ID NO: 10026 - DNA, 19 bp, synthetic construct
  source 1..19: mol_type = other DNA
accgaacaaccttgaccct

SEQ ID NO: 10027 - DNA, 18 bp, synthetic construct
  source 1..18: mol_type = other DNA
acacgtccacagccccca

SEQ ID NO: 10028 - DNA, 21 bp, synthetic construct
  source 1..21: mol_type = other DNA
agccggaccttacaaggcaac

SEQ ID NO: 10029 - DNA, 23 bp, synthetic construct
  source 1..23: mol_type = other DNA
acacaaaagagaggtcgtccgtc

SEQ ID NO: 10030 - DNA, 21 bp, synthetic construct
  source 1..21: mol_type = other DNA
agagaggacggacttggaacc

SEQ ID NO: 10031 - DNA, 23 bp, synthetic construct
  source 1..23: mol_type = other DNA
aaccctaaaaccgacgagaaagg

SEQ ID NO: 10032 - DNA, 20 bp, synthetic construct
  source 1..20: mol_type = other DNA
acgaaagtccacggtaggtg

SEQ ID NO: 10033 - DNA, 23 bp, synthetic construct
  source 1..23: mol_type = other DNA
aggacgtctagggaagtcaaaac

SEQ ID NO: 10034 - DNA, 18 bp, synthetic construct
  source 1..18: mol_type = other DNA
acccggactcagacaccc

SEQ ID NO: 10035 - DNA, 22 bp, synthetic construct
  source 1..22: mol_type = other DNA
agcaacgacggagaaacccaaa

SEQ ID NO: 10036 - DNA, 22 bp, synthetic construct
  source 1..22: mol_type = other DNA
agagacctccaccgtcatttgg

SEQ ID NO: 10037 - DNA, 21 bp, synthetic construct
  source 1..21: mol_type = other DNA
acccaggacctcatttacgac

SEQ ID NO: 10038 - DNA, 22 bp, synthetic construct
  source 1..22: mol_type = other DNA
aacccgtcttgaggaaaagaaa

SEQ ID NO: 10039 - DNA, 21 bp, synthetic construct
  source 1..21: mol_type = other DNA
aacctcgtccgagtaaaggac

SEQ ID NO: 10040 - DNA, 20 bp, synthetic construct
  source 1..20: mol_type = other DNA
agagggtcgacacagctctg

SEQ ID NO: 10041 - DNA, 18 bp, synthetic construct
  source 1..18: mol_type = other DNA
acgaggagaaggggtgcc

SEQ ID NO: 10042 - DNA, 18 bp, synthetic construct
  source 1..18: mol_type = other DNA
agccccgtgtaagaggtc

SEQ ID NO: 10043 - DNA, 21 bp, synthetic construct
  source 1..21: mol_type = other DNA
aacgacatcagtgctccgagg

SEQ ID NO: 10044 - DNA, 20 bp, synthetic construct
  source 1..20: mol_type = other DNA
acacaggtgtgccccccgga

SEQ ID NO: 10045 - DNA, 18 bp, synthetic construct
  source 1..18: mol_type = other DNA
agagccaagaaggctcgg

SEQ ID NO: 10046 - DNA, 21 bp, synthetic construct
  source 1..21: mol_type = other DNA
acgactctaccctgacctcaa

SEQ ID NO: 10047 - DNA, 18 bp, synthetic construct
  source 1..18: mol_type = other DNA
acgcagacgtagaccctg

SEQ ID NO: 10048 - DNA, 21 bp, synthetic construct
  source 1..21: mol_type = other DNA
agacgtagggtctgaggtcgg

SEQ ID NO: 10049 - DNA, 18 bp, synthetic construct
  source 1..18: mol_type = other DNA
acggccttgtaggagagg

SEQ ID NO: 10050 - DNA, 20 bp, synthetic construct
  source 1..20: mol_type = other DNA
agagggtctcgcaacccgtg

SEQ ID NO: 10051 - DNA, 18 bp, synthetic construct
  source 1..18: mol_type = other DNA
actgacaacaggctgccg

SEQ ID NO: 10052 - DNA, 18 bp, synthetic construct
  source 1..18: mol_type = other DNA
aggagggagaggtccgcc

SEQ ID NO: 10053 - DNA, 20 bp, synthetic construct
  source 1..20: mol_type = other DNA
accccagtgtccacagtgac

SEQ ID NO: 10054 - DNA, 20 bp, synthetic construct
  source 1..20: mol_type = other DNA
acgggtagtcactcgaggtg

SEQ ID NO: 10055 - DNA, 18 bp, synthetic construct
  source 1..18: mol_type = other DNA
accactgacggtggctca

SEQ ID NO: 10056 - DNA, 19 bp, synthetic construct
  source 1..19: mol_type = other DNA
acacaggagtcccaggtcc

SEQ ID NO: 10057 - DNA, 18 bp, synthetic construct
  source 1..18: mol_type = other DNA
acaccaacgagacgcgca

SEQ ID NO: 10058 - DNA, 18 bp, synthetic construct
  source 1..18: mol_type = other DNA
accgaaacagcgtgaccg

SEQ ID NO: 10059 - DNA, 18 bp, synthetic construct
  source 1..18: mol_type = other DNA
acgagtgggggacacact

SEQ ID NO: 10060 - DNA, 18 bp, synthetic construct
  source 1..18: mol_type = other DNA
accgacgtagtcacagcc

SEQ ID NO: 10061 - DNA, 18 bp, synthetic construct
  source 1..18: mol_type = other DNA
aggaccggtcagtgcact

SEQ ID NO: 10062 - DNA, 20 bp, synthetic construct
  source 1..20: mol_type = other DNA
acgggagagaaggtcgagac

SEQ ID NO: 10063 - DNA, 20 bp, synthetic construct
  source 1..20: mol_type = other DNA
aagcactgtgcctgcacgag

SEQ ID NO: 10064 - DNA, 22 bp, synthetic construct
  source 1..22: mol_type = other DNA
aggactcactacaagtcgacgt

SEQ ID NO: 10065 - DNA, 19 bp, synthetic construct
  source 1..19: mol_type = other DNA
acccgactgttgacctccg

SEQ ID NO: 10066 - DNA, 18 bp, synthetic construct
  source 1..18: mol_type = other DNA
agcccaccaacacacgac

SEQ ID NO: 10067 - DNA, 18 bp, synthetic construct
  source 1..18: mol_type = other DNA
accaggacggagggagga

SEQ ID NO: 10068 - DNA, 20 bp, synthetic construct
  source 1..20: mol_type = other DNA
acacgaacgagacaggtgtc

SEQ ID NO: 10069 - DNA, 18 bp, synthetic construct
  source 1..18: mol_type = other DNA
agacctaccacccctcca

SEQ ID NO: 10070 - DNA, 21 bp, synthetic construct
  source 1..21: mol_type = other DNA
acctctgagggcactcgtaca

SEQ ID NO: 10071 - DNA, 20 bp, synthetic construct
  source 1..20: mol_type = other DNA
acacgtcagggaggtcgaag

SEQ ID NO: 10072 - DNA, 18 bp, synthetic construct
  source 1..18: mol_type = other DNA
acactacccgactcccac

SEQ ID NO: 10073 - DNA, 20 bp, synthetic construct
  source 1..20: mol_type = other DNA
accaagacgactcgaaccac

SEQ ID NO: 10074 - DNA, 21 bp, synthetic construct
  source 1..21: mol_type = other DNA
agagaggactccagtggcacc

SEQ ID NO: 10075 - DNA, 18 bp, synthetic construct
  source 1..18: mol_type = other DNA
acaccgacccccagtgtc

SEQ ID NO: 10076 - DNA, 18 bp, synthetic construct
  source 1..18: mol_type = other DNA
acgggactgcagctacag

SEQ ID NO: 10077 - DNA, 18 bp, synthetic construct
  source 1..18: mol_type = other DNA
accccgaccctcaagtcc

SEQ ID NO: 10078 - DNA, 21 bp, synthetic construct
  source 1..21: mol_type = other DNA
aaggacctgcagtcgtcgacc

SEQ ID NO: 10079 - DNA, 19 bp, synthetic construct
  source 1..19: mol_type = other DNA
accccctgactgggacatc

SEQ ID NO: 10080 - DNA, 20 bp, synthetic construct
  source 1..20: mol_type = other DNA
aggaggagccacatctggtc

SEQ ID NO: 10081 - DNA, 18 bp, synthetic construct
  source 1..18: mol_type = other DNA
agaggagcagcccgcaca

SEQ ID NO: 10082 - DNA, 18 bp, synthetic construct
  source 1..18: mol_type = other DNA
aacgcctgttaccgacac

SEQ ID NO: 10083 - DNA, 20 bp, synthetic construct
  source 1..20: mol_type = other DNA
aagcccacatccgactcaag

SEQ ID NO: 10084 - DNA, 18 bp, synthetic construct
  source 1..18: mol_type = other DNA
agcagcgggtggtacggc

SEQ ID NO: 10085 - DNA, 18 bp, synthetic construct
  source 1..18: mol_type = other DNA
aggcatcccggtcaggta

SEQ ID NO: 10086 - DNA, 20 bp, synthetic construct
  source 1..20: mol_type = other DNA
accactgccgcctggaaagc

SEQ ID NO: 10087 - DNA, 20 bp, synthetic construct
  source 1..20: mol_type = other DNA
aggggtcgccaccacttgac

SEQ ID NO: 10088 - DNA, 21 bp, synthetic construct
  source 1..21: mol_type = other DNA
aggcaaccacgaccttcggga

SEQ ID NO: 10089 - DNA, 19 bp, synthetic construct
  source 1..19: mol_type = other DNA
accgagatccccgtcactc

SEQ ID NO: 10090 - DNA, 21 bp, synthetic construct
  source 1..21: mol_type = other DNA
aggaggacacctcatccgacg

SEQ ID NO: 10091 - DNA, 25 bp, synthetic construct
  source 1..25: mol_type = other DNA
accaacagattcgggaacaggaact

SEQ ID NO: 10092 - DNA, 21 bp, synthetic construct
  source 1..21: mol_type = other DNA
aagtgtgacacacggactggt

SEQ ID NO: 10093 - DNA, 19 bp, synthetic construct
  source 1..19: mol_type = other DNA
agcgagagacacgtgaggg

SEQ ID NO: 10094 - DNA, 18 bp, synthetic construct
  source 1..18: mol_type = other DNA
acggcaactccaaccgtg

SEQ ID NO: 10095 - DNA, 20 bp, synthetic construct
  source 1..20: mol_type = other DNA
aggaggtccgactgaaggag

SEQ ID NO: 10096 - DNA, 20 bp, synthetic construct
  source 1..20: mol_type = other DNA
acaggcagggattggatccg

SEQ ID NO: 10097 - DNA, 21 bp, synthetic construct
  source 1..21: mol_type = other DNA
acgaccgaccgggtgtttgta

SEQ ID NO: 10098 - DNA, 18 bp, synthetic construct
  source 1..18: mol_type = other DNA
aacggcgtcgtcgactca

SEQ ID NO: 10099 - DNA, 18 bp, synthetic construct
  source 1..18: mol_type = other DNA
acgccgtaaactcgagcc

SEQ ID NO: 10100 - DNA, 21 bp, synthetic construct
  source 1..21: mol_type = other DNA
acagacggggaacctgtaaga

SEQ ID NO: 10101 - DNA, 20 bp, synthetic construct
  source 1..20: mol_type = other DNA
agtcaagccgagacgcctgg

SEQ ID NO: 10102 - DNA, 22 bp, synthetic construct
  source 1..22: mol_type = other DNA
agcaaccgtcgaaacgtgagta

SEQ ID NO: 10103 - DNA, 19 bp, synthetic construct
  source 1..19: mol_type = other DNA
aaggacgtcgggacctatg

SEQ ID NO: 10104 - DNA, 23 bp, synthetic construct
  source 1..23: mol_type = other DNA
acccttagaaacaaaggaccccg

SEQ ID NO: 10105 - DNA, 18 bp, synthetic construct
  source 1..18: mol_type = other DNA
aacggtgaagaccgaggc

SEQ ID NO: 10106 - DNA, 18 bp, synthetic construct
  source 1..18: mol_type = other DNA
acggagcgtgagcaagtg

SEQ ID NO: 10107 - DNA, 18 bp, synthetic construct
  source 1..18: mol_type = other DNA
agagacccccgtcaccga

SEQ ID NO: 10108 - DNA, 18 bp, synthetic construct
  source 1..18: mol_type = other DNA
aggcaaacggtagctccg

SEQ ID NO: 10109 - DNA, 20 bp, synthetic construct
  source 1..20: mol_type = other DNA
acacccccagaatccgtgag

SEQ ID NO: 10110 - DNA, 20 bp, synthetic construct
  source 1..20: mol_type = other DNA
aacccatcgaaagtcccgtc

SEQ ID NO: 10111 - DNA, 18 bp, synthetic construct
  source 1..18: mol_type = other DNA
agcaggcaagcgaccctc

SEQ ID NO: 10112 - DNA, 21 bp, synthetic construct
  source 1..21: mol_type = other DNA
agacgttgcagacagacgaaa

SEQ ID NO: 10113 - DNA, 18 bp, synthetic construct
  source 1..18: mol_type = other DNA
acccgaacacgtggagtc

SEQ ID NO: 10114 - DNA, 18 bp, synthetic construct
  source 1..18: mol_type = other DNA
aacgacgccaggaccacc

SEQ ID NO: 10115 - DNA, 18 bp, synthetic construct
  source 1..18: mol_type = other DNA
agtcgacgaccaagcgga

SEQ ID NO: 10116 - DNA, 21 bp, synthetic construct
  source 1..21: mol_type = other DNA
atcgtcaggtcaggaggtcgt

SEQ ID NO: 10117 - DNA, 20 bp, synthetic construct
  source 1..20: mol_type = other DNA
acgtgggagaacttcgccgt

SEQ ID NO: 10118 - DNA, 20 bp, synthetic construct
  source 1..20: mol_type = other DNA
agggtgactaccggggactc

SEQ ID NO: 10119 - DNA, 18 bp, synthetic construct
  source 1..18: mol_type = other DNA
aggggagctaccggaaag

SEQ ID NO: 10120 - DNA, 18 bp, synthetic construct
  source 1..18: mol_type = other DNA
aacgactcagcagcccca

SEQ ID NO: 10121 - DNA, 19 bp, synthetic construct
  source 1..19: mol_type = other DNA
acgagggactacaggtccc

SEQ ID NO: 10122 - DNA, 17 bp, synthetic construct
  source 1..17: mol_type = other DNA
agacggcggaggcgacc

SEQ ID NO: 10123 - DNA, 19 bp, synthetic construct
  source 1..19: mol_type = other DNA
agggaccagagggaagacc

SEQ ID NO: 10124 - DNA, 19 bp, synthetic construct
  source 1..19: mol_type = other DNA
acactgaagaccccgtccc

SEQ ID NO: 10125 - DNA, 18 bp, synthetic construct
  source 1..18: mol_type = other DNA
aacggcacggcaactgca

SEQ ID NO: 10126 - DNA, 21 bp, synthetic construct
  source 1..21: mol_type = other DNA
agcaggggtaactactcgctc

SEQ ID NO: 10127 - DNA, 20 bp, synthetic construct
  source 1..20: mol_type = other DNA
agggagactcaggtgacgtc

SEQ ID NO: 10128 - DNA, 20 bp, synthetic construct
  source 1..20: mol_type = other DNA
aaggcacctcgtcaacgccg

SEQ ID NO: 10129 - DNA, 20 bp, synthetic construct
  source 1..20: mol_type = other DNA
agacctagagccctcacctc

SEQ ID NO: 10130 - DNA, 18 bp, synthetic construct
  source 1..18: mol_type = other DNA
agcccgacgaagttggac

SEQ ID NO: 10131 - DNA, 18 bp, synthetic construct
  source 1..18: mol_type = other DNA
acacaacagggcaccggt

SEQ ID NO: 10132 - DNA, 20 bp, synthetic construct
  source 1..20: mol_type = other DNA
agacgaagacggtaggtcaa

SEQ ID NO: 10133 - DNA, 20 bp, synthetic construct
  source 1..20: mol_type = other DNA
acaggtgggagaaccagtag

SEQ ID NO: 10134 - DNA, 18 bp, synthetic construct
  source 1..18: mol_type = other DNA
aggaggagacgcgactgg

SEQ ID NO: 10135 - DNA, 20 bp, synthetic construct
  source 1..20: mol_type = other DNA
aggatgaaaccgaccgctta

SEQ ID NO: 10136 - DNA, 20 bp, synthetic construct
  source 1..20: mol_type = other DNA
acccactactacggacagtg

SEQ ID NO: 10137 - DNA, 22 bp, synthetic construct
  source 1..22: mol_type = other DNA
agtccgacggttacaacgagtt

SEQ ID NO: 10138 - DNA, 20 bp, synthetic construct
  source 1..20: mol_type = other DNA
agacgtcgactgtcggacac

SEQ ID NO: 10139 - DNA, 18 bp, synthetic construct
  source 1..18: mol_type = other DNA
aacgggagactccggagc

SEQ ID NO: 10140 - DNA, 18 bp, synthetic construct
  source 1..18: mol_type = other DNA
acgacccacaacaccgag

SEQ ID NO: 10141 - DNA, 20 bp, synthetic construct
  source 1..20: mol_type = other DNA
acacagaggtgccagggacc

SEQ ID NO: 10142 - DNA, 18 bp, synthetic construct
  source 1..18: mol_type = other DNA
accccgactatgtagggc

SEQ ID NO: 10143 - DNA, 18 bp, synthetic construct
  source 1..18: mol_type = other DNA
aaccaagcccgtccgtca

SEQ ID NO: 10144 - DNA, 21 bp, synthetic construct
  source 1..21: mol_type = other DNA
acccactaaagcacaggatac

SEQ ID NO: 10145 - DNA, 23 bp, synthetic construct
  source 1..23: mol_type = other DNA
aagacgccgacgtgtcataaacc

SEQ ID NO: 10146 - DNA, 22 bp, synthetic construct
  source 1..22: mol_type = other DNA
acgtaaagagcctcggagagtc

SEQ ID NO: 10147 - DNA, 20 bp, synthetic construct
  source 1..20: mol_type = other DNA
aggaaagggtggaccctgta

SEQ ID NO: 10148 - DNA, 20 bp, synthetic construct
  source 1..20: mol_type = other DNA
aaccccactatcgtgagcac

SEQ ID NO: 10149 - DNA, 18 bp, synthetic construct
  source 1..18: mol_type = other DNA
agccaaggaccaggtcca

SEQ ID NO: 10150 - DNA, 18 bp, synthetic construct
  source 1..18: mol_type = other DNA
accgccagaggtgggatc

SEQ ID NO: 10151 - DNA, 18 bp, synthetic construct
  source 1..18: mol_type = other DNA
agacgtggcacaactcgt

SEQ ID NO: 10152 - DNA, 21 bp, synthetic construct
  source 1..21: mol_type = other DNA
aagctgcgcaggaaaggaccg

SEQ ID NO: 10153 - DNA, 20 bp, synthetic construct
  source 1..20: mol_type = other DNA
aacgggaaccctcatcacct

SEQ ID NO: 10154 - DNA, 20 bp, synthetic construct
  source 1..20: mol_type = other DNA
agtccacccaagaagtggac

SEQ ID NO: 10155 - DNA, 18 bp, synthetic construct
  source 1..18: mol_type = other DNA
acgggtgcggactatcca

SEQ ID NO: 10156 - DNA, 18 bp, synthetic construct
  source 1..18: mol_type = other DNA
aacccaagccctcagcag

SEQ ID NO: 10157 - DNA, 20 bp, synthetic construct
  source 1..20: mol_type = other DNA
acccctgtcgacggtaccat

SEQ ID NO: 10158 - DNA, 21 bp, synthetic construct
  source 1..21: mol_type = other DNA
accggtcctactgcaccaact

SEQ ID NO: 10159 - DNA, 20 bp, synthetic construct
  source 1..20: mol_type = other DNA
atcccggaaagtaaccgaga

SEQ ID NO: 10160 - DNA, 18 bp, synthetic construct
  source 1..18: mol_type = other DNA
acgtcaccacccctactc

SEQ ID NO: 10161 - DNA, 19 bp, synthetic construct
  source 1..19: mol_type = other DNA
acagatcgaccggggaagg

SEQ ID NO: 10162 - DNA, 22 bp, synthetic construct
  source 1..22: mol_type = other DNA
acacaggtactccaaccgaagg

SEQ ID NO: 10163 - DNA, 18 bp, synthetic construct
  source 1..18: mol_type = other DNA
agcacgaccgtcgagagt

SEQ ID NO: 10164 - DNA, 20 bp, synthetic construct
  source 1..20: mol_type = other DNA
acacagaggtgcagcacctg

SEQ ID NO: 10165 - DNA, 22 bp, synthetic construct
  source 1..22: mol_type = other DNA
acccctaacacgaccggtaaac

SEQ ID NO: 10166 - DNA, 18 bp, synthetic construct
  source 1..18: mol_type = other DNA
acgcagcactccgagttc

SEQ ID NO: 10167 - DNA, 20 bp, synthetic construct
  source 1..20: mol_type = other DNA
acgatagagggcgtgtcacc

SEQ ID NO: 10168 - DNA, 18 bp, synthetic construct
  source 1..18: mol_type = other DNA
acaccccagacccggacc

SEQ ID NO: 10169 - DNA, 18 bp, synthetic construct
  source 1..18: mol_type = other DNA
accggacccaagcccatt

SEQ ID NO: 10170 - DNA, 18 bp, synthetic construct
  source 1..18: mol_type = other DNA
acgacgtccgccaagaac

SEQ ID NO: 10171 - DNA, 20 bp, synthetic construct
  source 1..20: mol_type = other DNA
acggtcccgtgcaacgaaag

SEQ ID NO: 10172 - DNA, 18 bp, synthetic construct
  source 1..18: mol_type = other DNA
aaggcgagctagagacgg

SEQ ID NO: 10173 - DNA, 18 bp, synthetic construct
  source 1..18: mol_type = other DNA
aaccagaggtcccaccgt

SEQ ID NO: 10174 - DNA, 18 bp, synthetic construct
  source 1..18: mol_type = other DNA
aggaagtcgacgaacccg

SEQ ID NO: 10175 - DNA, 22 bp, synthetic construct
  source 1..22: mol_type = other DNA
aggagtatccacggacacagga

SEQ ID NO: 10176 - DNA, 22 bp, synthetic construct
  source 1..22: mol_type = other DNA
agacgaccgtaaagaggcgaaa

SEQ ID NO: 10177 - DNA, 20 bp, synthetic construct
  source 1..20: mol_type = other DNA
aaccctggcctcacgtgacc

SEQ ID NO: 10178 - DNA, 22 bp, synthetic construct
  source 1..22: mol_type = other DNA
agagagtcctcctccgagtaga

SEQ ID NO: 10179 - DNA, 19 bp, synthetic construct
  source 1..19: mol_type = other DNA
accgacgtcaatctccccg

SEQ ID NO: 10180 - DNA, 18 bp, synthetic construct
  source 1..18: mol_type = other DNA
acggaaaccctgaccacc

SEQ ID NO: 10181 - DNA, 19 bp, synthetic construct
  source 1..19: mol_type = other DNA
accggagactgagtgacgg

SEQ ID NO: 10182 - DNA, 18 bp, synthetic construct
  source 1..18: mol_type = other DNA
accgcccaagacctctcg

SEQ ID NO: 10183 - DNA, 20 bp, synthetic construct
  source 1..20: mol_type = other DNA
agacccagggcgaacagtcg

SEQ ID NO: 10184 - DNA, 21 bp, synthetic construct
  source 1..21: mol_type = other DNA
agaagtccacgttccgaccac

SEQ ID NO: 10185 - DNA, 21 bp, synthetic construct
  source 1..21: mol_type = other DNA
acctctgagtccccgaacaga

SEQ ID NO: 10186 - DNA, 19 bp, synthetic construct
  source 1..19: mol_type = other DNA
agcgtgcagggcctacacg

SEQ ID NO: 10187 - DNA, 18 bp, synthetic construct
  source 1..18: mol_type = other DNA
acccaacagagcgttccg

SEQ ID NO: 10188 - DNA, 18 bp, synthetic construct
  source 1..18: mol_type = other DNA
aggaccgtgacgagagcc

SEQ ID NO: 10189 - DNA, 20 bp, synthetic construct
  source 1..20: mol_type = other DNA
aggcgacgtccatggtcaac

SEQ ID NO: 10190 - DNA, 18 bp, synthetic construct
  source 1..18: mol_type = other DNA
accaaggtaccctggtcc

SEQ ID NO: 10191 - DNA, 22 bp, synthetic construct
  source 1..22: mol_type = other DNA
agcggaaggagatcgtttagac

SEQ ID NO: 10192 - DNA, 19 bp, synthetic construct
  source 1..19: mol_type = other DNA
accgaaggaccatcctccg

SEQ ID NO: 10193 - DNA, 18 bp, synthetic construct
  source 1..18: mol_type = other DNA
acgaagggtgcgaccact

SEQ ID NO: 10194 - DNA, 20 bp, synthetic construct
  source 1..20: mol_type = other DNA
acgaggacacagtgcaacca

SEQ ID NO: 10195 - DNA, 18 bp, synthetic construct
  source 1..18: mol_type = other DNA
aaccccgttcactcaccg

SEQ ID NO: 10196 - DNA, 22 bp, synthetic construct
  source 1..22: mol_type = other DNA
acccccataaagcttgcctaac

SEQ ID NO: 10197 - DNA, 21 bp, synthetic construct
  source 1..21: mol_type = other DNA
agacctacacgacccaacctc

SEQ ID NO: 10198 - DNA, 18 bp, synthetic construct
  source 1..18: mol_type = other DNA
agccgcctgccaagcaca

SEQ ID NO: 10199 - DNA, 22 bp, synthetic construct
  source 1..22: mol_type = other DNA
acggtggtagtagagaagggtc

SEQ ID NO: 10200 - DNA, 19 bp, synthetic construct
  source 1..19: mol_type = other DNA
acgactagacccacagggc

SEQ ID NO: 10201 - DNA, 19 bp, synthetic construct
  source 1..19: mol_type = other DNA
aggagtctggctccgtctc

SEQ ID NO: 10202 - DNA, 18 bp, synthetic construct
  source 1..18: mol_type = other DNA
acacgagcccgaccatcg

SEQ ID NO: 10203 - DNA, 20 bp, synthetic construct
  source 1..20: mol_type = other DNA
agcagagtccgagacgaggg

SEQ ID NO: 10204 - DNA, 18 bp, synthetic construct
  source 1..18: mol_type = other DNA
aagcgaagaacggccgca

SEQ ID NO: 10205 - DNA, 20 bp, synthetic construct
  source 1..20: mol_type = other DNA
agacccccagcagaccataa

SEQ ID NO: 10206 - DNA, 18 bp, synthetic construct
  source 1..18: mol_type = other DNA
accacggtgggtaaccac

SEQ ID NO: 10207 - DNA, 21 bp, synthetic construct
  source 1..21: mol_type = other DNA
acacagcacacggacgtcgct

SEQ ID NO: 10208 - DNA, 18 bp, synthetic construct
  source 1..18: mol_type = other DNA
acgaccttccggtccacg

SEQ ID NO: 10209 - DNA, 18 bp, synthetic construct
  source 1..18: mol_type = other DNA
acggaagggcacctagag

SEQ ID NO: 10210 - DNA, 18 bp, synthetic construct
  source 1..18: mol_type = other DNA
aacgactagggcgtcgtg

SEQ ID NO: 10211 - DNA, 20 bp, synthetic construct
  source 1..20: mol_type = other DNA
agagcgtcaacccaggacac

SEQ ID NO: 10212 - DNA, 18 bp, synthetic construct
  source 1..18: mol_type = other DNA
accggcagctagttaccc

SEQ ID NO: 10213 - DNA, 19 bp, synthetic construct
  source 1..19: mol_type = other DNA
agagcatgtggcccaacgt

SEQ ID NO: 10214 - DNA, 19 bp, synthetic construct
  source 1..19: mol_type = other DNA
acggaaggcctcagtctcc

SEQ ID NO: 10215 - DNA, 22 bp, synthetic construct
  source 1..22: mol_type = other DNA
aggcgtgaaaccgaacagaaac

SEQ ID NO: 10216 - DNA, 18 bp, synthetic construct
  source 1..18: mol_type = other DNA
actgaaggggccaggtcc

SEQ ID NO: 10217 - DNA, 20 bp, synthetic construct
  source 1..20: mol_type = other DNA
acaggaacgagacccaggtc

SEQ ID NO: 10218 - DNA, 18 bp, synthetic construct
  source 1..18: mol_type = other DNA
accacgtaccgcaactgg

SEQ ID NO: 10219 - DNA, 20 bp, synthetic construct
  source 1..20: mol_type = other DNA
agaggtgaccagtacggtac

SEQ ID NO: 10220 - DNA, 19 bp, synthetic construct
  source 1..19: mol_type = other DNA
acgaaatcctcgcgactgt

SEQ ID NO: 10221 - DNA, 21 bp, synthetic construct
  source 1..21: mol_type = other DNA
acgggtcgaagagaggcagga

SEQ ID NO: 10222 - DNA, 22 bp, synthetic construct
  source 1..22: mol_type = other DNA
aaccaaagtgacctggacatga

SEQ ID NO: 10223 - DNA, 20 bp, synthetic construct
  source 1..20: mol_type = other DNA
agcggaccccaggtactgtc

SEQ ID NO: 10224 - DNA, 19 bp, synthetic construct
  source 1..19: mol_type = other DNA
agagagccacgaagggtgg

SEQ ID NO: 10225 - DNA, 18 bp, synthetic construct
  source 1..18: mol_type = other DNA
acaccggaggagaagcca

SEQ ID NO: 10226 - DNA, 18 bp, synthetic construct
  source 1..18: mol_type = other DNA
accggcatcgccacgtgc

SEQ ID NO: 10227 - DNA, 20 bp, synthetic construct
  source 1..20: mol_type = other DNA
aacgatacgtccactccgat

SEQ ID NO: 10228 - DNA, 18 bp, synthetic construct
  source 1..18: mol_type = other DNA
acacgggcagcgcccagc

SEQ ID NO: 10229 - DNA, 18 bp, synthetic construct
  source 1..18: mol_type = other DNA
agggaggcaagaccgtca

SEQ ID NO: 10230 - DNA, 20 bp, synthetic construct
  source 1..20: mol_type = other DNA
agagcctgcggaggaagtca

SEQ ID NO: 10231 - DNA, 19 bp, synthetic construct
  source 1..19: mol_type = other DNA
aggagtacaccccgagagc

SEQ ID NO: 10232 - DNA, 18 bp, synthetic construct
  source 1..18: mol_type = other DNA
aaggaccaccggtccaga

SEQ ID NO: 10233 - DNA, 21 bp, synthetic construct
  source 1..21: mol_type = other DNA
accacctcgactgcatcttct

SEQ ID NO: 10234 - DNA, 19 bp, synthetic construct
  source 1..19: mol_type = other DNA
aggcacagtggagacggag

SEQ ID NO: 10235 - DNA, 18 bp, synthetic construct
  source 1..18: mol_type = other DNA
accccagctacacctcct

SEQ ID NO: 10236 - DNA, 20 bp, synthetic construct
  source 1..20: mol_type = other DNA
acctgccgaaggagaaccac

SEQ ID NO: 10237 - DNA, 20 bp, synthetic construct
  source 1..20: mol_type = other DNA
agcgggcgtaacgacatcga

SEQ ID NO: 10238 - DNA, 21 bp, synthetic construct
  source 1..21: mol_type = other DNA
accaggttcatctccttccac

SEQ ID NO: 10239 - DNA, 18 bp, synthetic construct
  source 1..18: mol_type = other DNA
acgcccagaactcctacc

SEQ ID NO: 10240 - DNA, 18 bp, synthetic construct
  source 1..18: mol_type = other DNA
accggaaggacgaccaac

SEQ ID NO: 10241 - DNA, 19 bp, synthetic construct
  source 1..19: mol_type = other DNA
agacacacgagtccaggcg

SEQ ID NO: 10242 - DNA, 18 bp, synthetic construct
  source 1..18: mol_type = other DNA
aggagtagtcgacggtcc

SEQ ID NO: 10243 - DNA, 18 bp, synthetic construct
  source 1..18: mol_type = other DNA
agcgcctccggtaggtac

SEQ ID NO: 10244 - DNA, 21 bp, synthetic construct
  source 1..21: mol_type = other DNA
agagtagtccgaccaggaagt

SEQ ID NO: 10245 - DNA, 18 bp, synthetic construct
  source 1..18: mol_type = other DNA
acgaccgtaaccacaagg

SEQ ID NO: 10246 - DNA, 18 bp, synthetic construct
  source 1..18: mol_type = other DNA
acgagaaccggagggtgc

SEQ ID NO: 10247 - DNA, 20 bp, synthetic construct
  source 1..20: mol_type = other DNA
acgcgcctcaccgccatgac

SEQ ID NO: 10248 - DNA, 20 bp, synthetic construct
  source 1..20: mol_type = other DNA
acaccacggagatgacccaa

SEQ ID NO: 10249 - DNA, 20 bp, synthetic construct
  source 1..20: mol_type = other DNA
acacgcctgacgacggcttc

SEQ ID NO: 10250 - DNA, 18 bp, synthetic construct
  source 1..18: mol_type = other DNA
accggggaccaggccctt

SEQ ID NO: 10251 - DNA, 20 bp, synthetic construct
  source 1..20: mol_type = other DNA
actccaccactacgtccggg

SEQ ID NO: 10252 - DNA, 21 bp, synthetic construct
  source 1..21: mol_type = other DNA
agacggagagtgactagggaa

SEQ ID NO: 10253 - DNA, 20 bp, synthetic construct
  source 1..20: mol_type = other DNA
acgacaccggacccgataca

SEQ ID NO: 10254 - DNA, 18 bp, synthetic construct
  source 1..18: mol_type = other DNA
aggaggcacgcgttgtcg

SEQ ID NO: 10255 - DNA, 18 bp, synthetic construct
  source 1..18: mol_type = other DNA
aacggaagaacggggtcg

SEQ ID NO: 10256 - DNA, 21 bp, synthetic construct
  source 1..21: mol_type = other DNA
agcgagacgtcactcaagaag

SEQ ID NO: 10257 - DNA, 21 bp, synthetic construct
  source 1..21: mol_type = other DNA
accctttccaccaccaccaga

SEQ ID NO: 10258 - DNA, 19 bp, synthetic construct
  source 1..19: mol_type = other DNA
acccatcaactccccgtcc

SEQ ID NO: 10259 - DNA, 20 bp, synthetic construct
  source 1..20: mol_type = other DNA
acgaccagtgacggagacct

SEQ ID NO: 10260 - DNA, 19 bp, synthetic construct
  source 1..19: mol_type = other DNA
accacctcaactcccctcc

SEQ ID NO: 10261 - DNA, 18 bp, synthetic construct
  source 1..18: mol_type = other DNA
acacctacgacgacgacc

SEQ ID NO: 10262 - DNA, 21 bp, synthetic construct
  source 1..21: mol_type = other DNA
aaccccgacgtctaccagtgt

SEQ ID NO: 10263 - DNA, 19 bp, synthetic construct
  source 1..19: mol_type = other DNA
aaccggagagaggagcgac

SEQ ID NO: 10264 - DNA, 20 bp, synthetic construct
  source 1..20: mol_type = other DNA
aggacccactcaccctacac

SEQ ID NO: 10265 - DNA, 20 bp, synthetic construct
  source 1..20: mol_type = other DNA
acgaaccggtccagtcctga

SEQ ID NO: 10266 - DNA, 19 bp, synthetic construct
  source 1..19: mol_type = other DNA
actccccaggaggaagtcc

SEQ ID NO: 10267 - DNA, 19 bp, synthetic construct
  source 1..19: mol_type = other DNA
accgagaaagtgccacacc

SEQ ID NO: 10268 - DNA, 19 bp, synthetic construct
  source 1..19: mol_type = other DNA
agaggaaggcccagcagag

SEQ ID NO: 10269 - DNA, 18 bp, synthetic construct
  source 1..18: mol_type = other DNA
aaccggtaggccatgggt

SEQ ID NO: 10270 - DNA, 19 bp, synthetic construct
  source 1..19: mol_type = other DNA
aaccggtggaccatcgact

SEQ ID NO: 10271 - DNA, 18 bp, synthetic construct
  source 1..18: mol_type = other DNA
agccagtacctagtcccc

SEQ ID NO: 10272 - DNA, 18 bp, synthetic construct
  source 1..18: mol_type = other DNA
aggacccggtccactcag

SEQ ID NO: 10273 - DNA, 20 bp, synthetic construct
  source 1..20: mol_type = other DNA
aacccgtccctgaacctcct

SEQ ID NO: 10274 - DNA, 21 bp, synthetic construct
  source 1..21: mol_type = other DNA
aacccccgtgcctacatgaac

SEQ ID NO: 10275 - DNA, 18 bp, synthetic construct
  source 1..18: mol_type = other DNA
acagccgtccaagtggtc

SEQ ID NO: 10276 - DNA, 20 bp, synthetic construct
  source 1..20: mol_type = other DNA
accttccgccggaacacgac

SEQ ID NO: 10277 - DNA, 18 bp, synthetic construct
  source 1..18: mol_type = other DNA
accgacccgtcagtggaa

SEQ ID NO: 10278 - DNA, 18 bp, synthetic construct
  source 1..18: mol_type = other DNA
agacgacttcggaggcgt

SEQ ID NO: 10279 - DNA, 18 bp, synthetic construct
  source 1..18: mol_type = other DNA
aacgggtcaaggaaccgg

SEQ ID NO: 10280 - DNA, 20 bp, synthetic construct
  source 1..20: mol_type = other DNA
acacacatgacgtggccgag

SEQ ID NO: 10281 - DNA, 18 bp, synthetic construct
  source 1..18: mol_type = other DNA
acacgtcgccgacctacc

SEQ ID NO: 10282 - DNA, 18 bp, synthetic construct
  source 1..18: mol_type = other DNA
acacaccgcgactagtgg

SEQ ID NO: 10283 - DNA, 20 bp, synthetic construct
  source 1..20: mol_type = other DNA
aggctatcgagtcccaggac

SEQ ID NO: 10284 - DNA, 19 bp, synthetic construct
  source 1..19: mol_type = other DNA
acagacgggtggagaacgg

SEQ ID NO: 10285 - DNA, 18 bp, synthetic construct
  source 1..18: mol_type = other DNA
actccggcgtcagacgga

SEQ ID NO: 10286 - DNA, 21 bp, synthetic construct
  source 1..21: mol_type = other DNA
aaggaccgaaggacctgaaac

SEQ ID NO: 10287 - DNA, 19 bp, synthetic construct
  source 1..19: mol_type = other DNA
acgacctgtcgacctggag

SEQ ID NO: 10288 - DNA, 22 bp, synthetic construct
  source 1..22: mol_type = other DNA
acaggtcccgactcaaagacta

SEQ ID NO: 10289 - DNA, 21 bp, synthetic construct
  source 1..21: mol_type = other DNA
acgaggaagcggctctaagac

SEQ ID NO: 10290 - DNA, 18 bp, synthetic construct
  source 1..18: mol_type = other DNA
accacggacactggcagt

SEQ ID NO: 10291 - DNA, 20 bp, synthetic construct
  source 1..20: mol_type = other DNA
agaccccactagtagccccg

SEQ ID NO: 10292 - DNA, 20 bp, synthetic construct
  source 1..20: mol_type = other DNA
acccggtcactcaactcgga

SEQ ID NO: 10293 - DNA, 19 bp, synthetic construct
  source 1..19: mol_type = other DNA
accagtgaacccagggagg

SEQ ID NO: 10294 - DNA, 18 bp, synthetic construct
  source 1..18: mol_type = other DNA
accccgtaccgtcaaacc

SEQ ID NO: 10295 - DNA, 18 bp, synthetic construct
  source 1..18: mol_type = other DNA
agagcaaccgtagcaccc

SEQ ID NO: 10296 - DNA, 20 bp, synthetic construct
  source 1..20: mol_type = other DNA
accgaggagccaccgaaagt

SEQ ID NO: 10297 - DNA, 18 bp, synthetic construct
  source 1..18: mol_type = other DNA
agagaaaggcctcgagcg

SEQ ID NO: 10298 - DNA, 20 bp, synthetic construct
  source 1..20: mol_type = other DNA
acagccccagcctctaaggg

SEQ ID NO: 10299 - DNA, 20 bp, synthetic construct
  source 1..20: mol_type = other DNA
atcggtctaagtcaccgtct

SEQ ID NO: 10300 - DNA, 21 bp, synthetic construct
  source 1..21: mol_type = other DNA
agacggtcacaccatgggtac

SEQ ID NO: 10301 - DNA, 23 bp, synthetic construct
  source 1..23: mol_type = other DNA
accaagaccttcgaagcacaacg

SEQ ID NO: 10302 - DNA, 18 bp, synthetic construct
  source 1..18: mol_type = other DNA
accgaaactgacgagccg

SEQ ID NO: 10303 - DNA, 21 bp, synthetic construct
  source 1..21: mol_type = other DNA
aggagagaccctccgtatacg

SEQ ID NO: 10304 - DNA, 18 bp, synthetic construct
  source 1..18: mol_type = other DNA
acacgaggtccagccgga

SEQ ID NO: 10305 - DNA, 20 bp, synthetic construct
  source 1..20: mol_type = other DNA
aaccgtagacctaccaagtg

SEQ ID NO: 10306 - DNA, 20 bp, synthetic construct
  source 1..20: mol_type = other DNA
aggcacttccaccaaacgac

SEQ ID NO: 10307 - DNA, 20 bp, synthetic construct
  source 1..20: mol_type = other DNA
acgcgaacgccgggacacgt

SEQ ID NO: 10308 - DNA, 20 bp, synthetic construct
  source 1..20: mol_type = other DNA
agaactccaaccggtcgcgc

SEQ ID NO: 10309 - DNA, 25 bp, synthetic construct
  source 1..25: mol_type = other DNA
aggtccaaaagaaagggatcgagga

SEQ ID NO: 10310 - DNA, 20 bp, synthetic construct
  source 1..20: mol_type = other DNA
agacgagaccacaccgtaac

SEQ ID NO: 10311 - DNA, 18 bp, synthetic construct
  source 1..18: mol_type = other DNA
acaccgtgcaagaggtcc

SEQ ID NO: 10312 - DNA, 20 bp, synthetic construct
  source 1..20: mol_type = other DNA
acccacggcatcaacctcta

SEQ ID NO: 10313 - DNA, 19 bp, synthetic construct
  source 1..19: mol_type = other DNA
aacggggacatcgtggagg

SEQ ID NO: 10314 - DNA, 20 bp, synthetic construct
  source 1..20: mol_type = other DNA
agccgaacaaggtgactgac

SEQ ID NO: 10315 - DNA, 20 bp, synthetic construct
  source 1..20: mol_type = other DNA
aagggcgtcaagtatggctc

SEQ ID NO: 10316 - DNA, 20 bp, synthetic construct
  source 1..20: mol_type = other DNA
agaggttgcggagaaaccag

SEQ ID NO: 10317 - DNA, 19 bp, synthetic construct
  source 1..19: mol_type = other DNA
acgcgactcagtggaggag

SEQ ID NO: 10318 - DNA, 18 bp, synthetic construct
  source 1..18: mol_type = other DNA
aacggaagagcgaagccg

SEQ ID NO: 10319 - DNA, 20 bp, synthetic construct
  source 1..20: mol_type = other DNA
acgaatcgtcctcccgagtg

SEQ ID NO: 10320 - DNA, 22 bp, synthetic construct
  source 1..22: mol_type = other DNA
agaactagcaacccgactaagg

SEQ ID NO: 10321 - DNA, 18 bp, synthetic construct
  source 1..18: mol_type = other DNA
acagcccgtgacacaacc

SEQ ID NO: 10322 - DNA, 20 bp, synthetic construct
  source 1..20: mol_type = other DNA
agaactcgtggtccggacac

SEQ ID NO: 10323 - DNA, 21 bp, synthetic construct
  source 1..21: mol_type = other DNA
aggacccacccgaaaaacgac

SEQ ID NO: 10324 - DNA, 18 bp, synthetic construct
  source 1..18: mol_type = other DNA
acgaccacaacgacaccg

SEQ ID NO: 10325 - DNA, 19 bp, synthetic construct
  source 1..19: mol_type = other DNA
actccaccaggcagaggag

SEQ ID NO: 10326 - DNA, 18 bp, synthetic construct
  source 1..18: mol_type = other DNA
acctgccacatgaccggg

SEQ ID NO: 10327 - DNA, 20 bp, synthetic construct
  source 1..20: mol_type = other DNA
agagacggaggaagacggtc

SEQ ID NO: 10328 - DNA, 18 bp, synthetic construct
  source 1..18: mol_type = other DNA
agcaggagaggccacgcg

SEQ ID NO: 10329 - DNA, 19 bp, synthetic construct
  source 1..19: mol_type = other DNA
agacgaaccacgactcccc

SEQ ID NO: 10330 - DNA, 18 bp, synthetic construct
  source 1..18: mol_type = other DNA
accccaccaagggactga

SEQ ID NO: 10331 - DNA, 20 bp, synthetic construct
  source 1..20: mol_type = other DNA
agacgagaggcgacactgaa

SEQ ID NO: 10332 - DNA, 18 bp, synthetic construct
  source 1..18: mol_type = other DNA
accagaccggtcgaccac

SEQ ID NO: 10333 - DNA, 19 bp, synthetic construct
  source 1..19: mol_type = other DNA
acgaggagaggtacgaggg

SEQ ID NO: 10334 - DNA, 18 bp, synthetic construct
  source 1..18: mol_type = other DNA
aacgagcaccgtcccaga

SEQ ID NO: 10335 - DNA, 18 bp, synthetic construct
  source 1..18: mol_type = other DNA
aagcccggagaaccctag

SEQ ID NO: 10336 - DNA, 20 bp, synthetic construct
  source 1..20: mol_type = other DNA
aggaagacacggtaagcgac

SEQ ID NO: 10337 - DNA, 20 bp, synthetic construct
  source 1..20: mol_type = other DNA
accgaggccgaagagagaac

SEQ ID NO: 10338 - DNA, 18 bp, synthetic construct
  source 1..18: mol_type = other DNA
aacgacgagaggggtagc

SEQ ID NO: 10339 - DNA, 20 bp, synthetic construct
  source 1..20: mol_type = other DNA
accgaacaacaggagaccgg

SEQ ID NO: 10340 - DNA, 20 bp, synthetic construct
  source 1..20: mol_type = other DNA
aggccggtcagacacttgac

SEQ ID NO: 10341 - DNA, 19 bp, synthetic construct
  source 1..19: mol_type = other DNA
aaggacggcagtgaggagg

SEQ ID NO: 10342 - DNA, 18 bp, synthetic construct
  source 1..18: mol_type = other DNA
aggtcatgccgcagccgg

SEQ ID NO: 10343 - DNA, 18 bp, synthetic construct
  source 1..18: mol_type = other DNA
acacccgagacccaacga

SEQ ID NO: 10344 - DNA, 20 bp, synthetic construct
  source 1..20: mol_type = other DNA
agacaggactccgcagtgtc

SEQ ID NO: 10345 - DNA, 18 bp, synthetic construct
  source 1..18: mol_type = other DNA
acgagcttcaccgatcgc

SEQ ID NO: 10346 - DNA, 21 bp, synthetic construct
  source 1..21: mol_type = other DNA
agaggagaaggagtggggacc

SEQ ID NO: 10347 - DNA, 19 bp, synthetic construct
  source 1..19: mol_type = other DNA
atccgaacacgaaggacct

SEQ ID NO: 10348 - DNA, 18 bp, synthetic construct
  source 1..18: mol_type = other DNA
acgtccctgactcccacc

SEQ ID NO: 10349 - DNA, 18 bp, synthetic construct
  source 1..18: mol_type = other DNA
acggacacctacggccac

SEQ ID NO: 10350 - DNA, 18 bp, synthetic construct
  source 1..18: mol_type = other DNA
acgccttgtgtacgaccc

SEQ ID NO: 10351 - DNA, 20 bp, synthetic construct
  source 1..20: mol_type = other DNA
agcccgacagtctcaactat

SEQ ID NO: 10352 - DNA, 21 bp, synthetic construct
  source 1..21: mol_type = other DNA
accagacgagagagacctgaa

SEQ ID NO: 10353 - DNA, 18 bp, synthetic construct
  source 1..18: mol_type = other DNA
aagggtggcgaccctact

SEQ ID NO: 10354 - DNA, 20 bp, synthetic construct
  source 1..20: mol_type = other DNA
agaggaggagtcccttcgtc

SEQ ID NO: 10355 - DNA, 20 bp, synthetic construct
  source 1..20: mol_type = other DNA
acctccactgcgagaccgtg

SEQ ID NO: 10356 - DNA, 18 bp, synthetic construct
  source 1..18: mol_type = other DNA
accgctccaacggacact

SEQ ID NO: 10357 - DNA, 18 bp, synthetic construct
  source 1..18: mol_type = other DNA
agcccccaaacgacagtc

SEQ ID NO: 10358 - DNA, 18 bp, synthetic construct
  source 1..18: mol_type = other DNA
aaggcacgcgcctacttc

SEQ ID NO: 10359 - DNA, 19 bp, synthetic construct
  source 1..19: mol_type = other DNA
acactcgccctaaggctat

SEQ ID NO: 10360 - DNA, 18 bp, synthetic construct
  source 1..18: mol_type = other DNA
agcggctcccgactagaa

SEQ ID NO: 10361 - DNA, 22 bp, synthetic construct
  source 1..22: mol_type = other DNA
acccgttccactacaagggcat

SEQ ID NO: 10362 - DNA, 18 bp, synthetic construct
  source 1..18: mol_type = other DNA
agaccgcgtaggcatagg

SEQ ID NO: 10363 - DNA, 20 bp, synthetic construct
  source 1..20: mol_type = other DNA
agacccacccgtcagaagtc

SEQ ID NO: 10364 - DNA, 21 bp, synthetic construct
  source 1..21: mol_type = other DNA
agaccccgcaagacacacagt

SEQ ID NO: 10365 - DNA, 19 bp, synthetic construct
  source 1..19: mol_type = other DNA
acgaccgatgtgtccgagg

SEQ ID NO: 10366 - DNA, 18 bp, synthetic construct
  source 1..18: mol_type = other DNA
aggaccgaagacgccgac

SEQ ID NO: 10367 - DNA, 21 bp, synthetic construct
  source 1..21: mol_type = other DNA
acaacggtcgtgtcagaggag

SEQ ID NO: 10368 - DNA, 18 bp, synthetic construct
  source 1..18: mol_type = other DNA
acggacgaacggcagcac

SEQ ID NO: 10369 - DNA, 20 bp, synthetic construct
  source 1..20: mol_type = other DNA
aacgcacttgtcggaccgga

SEQ ID NO: 10370 - DNA, 21 bp, synthetic construct
  source 1..21: mol_type = other DNA
acacatggcacctgacacctg

SEQ ID NO: 10371 - DNA, 21 bp, synthetic construct
  source 1..21: mol_type = other DNA
acaggtgcatccctcagaccg

SEQ ID NO: 10372 - DNA, 22 bp, synthetic construct
  source 1..22: mol_type = other DNA
aaggcaaagactgacgcacatc

SEQ ID NO: 10373 - DNA, 21 bp, synthetic construct
  source 1..21: mol_type = other DNA
agtccagtagggacatctgcc

SEQ ID NO: 10374 - DNA, 18 bp, synthetic construct
  source 1..18: mol_type = other DNA
accccaaccacggcctca

SEQ ID NO: 10375 - DNA, 20 bp, synthetic construct
  source 1..20: mol_type = other DNA
acgaaccgcatctctccgtc

SEQ ID NO: 10376 - DNA, 20 bp, synthetic construct
  source 1..20: mol_type = other DNA
aggcgtcgtcacggtacctg

SEQ ID NO: 10377 - DNA, 19 bp, synthetic construct
  source 1..19: mol_type = other DNA
aggcctcactcggagctgc

SEQ ID NO: 10378 - DNA, 18 bp, synthetic construct
  source 1..18: mol_type = other DNA
agctccaccaggggcgtc

SEQ ID NO: 10379 - DNA, 20 bp, synthetic construct
  source 1..20: mol_type = other DNA
agcacgcctggactcggtaa

SEQ ID NO: 10380 - DNA, 18 bp, synthetic construct
  source 1..18: mol_type = other DNA
acccctaagggcactggc

SEQ ID NO: 10381 - DNA, 18 bp, synthetic construct
  source 1..18: mol_type = other DNA
agcggggacctccagggc

SEQ ID NO: 10382 - DNA, 20 bp, synthetic construct
  source 1..20: mol_type = other DNA
actcctgcaactcccaccgt

SEQ ID NO: 10383 - DNA, 18 bp, synthetic construct
  source 1..18: mol_type = other DNA
acgggtcggtagagcggc

SEQ ID NO: 10384 - DNA, 18 bp, synthetic construct
  source 1..18: mol_type = other DNA
agcagaactccgccaagg

SEQ ID NO: 10385 - DNA, 20 bp, synthetic construct
  source 1..20: mol_type = other DNA
acctccgaggtaggagtcgt

SEQ ID NO: 10386 - DNA, 22 bp, synthetic construct
  source 1..22: mol_type = other DNA
acctcgacaacagttccatgta

SEQ ID NO: 10387 - DNA, 21 bp, synthetic construct
  source 1..21: mol_type = other DNA
accccgaaggtgaactcgact

SEQ ID NO: 10388 - DNA, 21 bp, synthetic construct
  source 1..21: mol_type = other DNA
accgctaccgtctcgacatgg

SEQ ID NO: 10389 - DNA, 19 bp, synthetic construct
  source 1..19: mol_type = other DNA
acccccacacagtttacct

SEQ ID NO: 10390 - DNA, 18 bp, synthetic construct
  source 1..18: mol_type = other DNA
agacccgaccgaagtcga

SEQ ID NO: 10391 - DNA, 18 bp, synthetic construct
  source 1..18: mol_type = other DNA
acccgaagagcaacaggg

SEQ ID NO: 10392 - DNA, 20 bp, synthetic construct
  source 1..20: mol_type = other DNA
agaggtgcgtcaggaggaac

SEQ ID NO: 10393 - DNA, 19 bp, synthetic construct
  source 1..19: mol_type = other DNA
accgtacgacaaacacgtc

SEQ ID NO: 10394 - DNA, 18 bp, synthetic construct
  source 1..18: mol_type = other DNA
aacgaccgacggtaccct

SEQ ID NO: 10395 - DNA, 18 bp, synthetic construct
  source 1..18: mol_type = other DNA
aagcggagaccttaacgg

SEQ ID NO: 10396 - DNA, 18 bp, synthetic construct
  source 1..18: mol_type = other DNA
acccctggtaaacaggca

SEQ ID NO: 10397 - DNA, 18 bp, synthetic construct
  source 1..18: mol_type = other DNA
agaccaggaccgacaggt

SEQ ID NO: 10398 - DNA, 20 bp, synthetic construct
  source 1..20: mol_type = other DNA
agacccgtcatcgaccgatg

SEQ ID NO: 10399 - DNA, 19 bp, synthetic construct
  source 1..19: mol_type = other DNA
agaccaagtcctgtcccgg

SEQ ID NO: 10400 - DNA, 18 bp, synthetic construct
  source 1..18: mol_type = other DNA
agagccggaagttgtgcg

SEQ ID NO: 10401 - DNA, 18 bp, synthetic construct
  source 1..18: mol_type = other DNA
acgagccacctccacagg

SEQ ID NO: 10402 - DNA, 18 bp, synthetic construct
  source 1..18: mol_type = other DNA
aacggtgacacgagtccg

SEQ ID NO: 10403 - DNA, 18 bp, synthetic construct
  source 1..18: mol_type = other DNA
acccaagccccaacaacg

SEQ ID NO: 10404 - DNA, 21 bp, synthetic construct
  source 1..21: mol_type = other DNA
aggacacgtcaggggattcgg

SEQ ID NO: 10405 - DNA, 21 bp, synthetic construct
  source 1..21: mol_type = other DNA
agacgaggtgcaagaggaaca

SEQ ID NO: 10406 - DNA, 20 bp, synthetic construct
  source 1..20: mol_type = other DNA
accaggtgcaccttcaggag

SEQ ID NO: 10407 - DNA, 20 bp, synthetic construct
  source 1..20: mol_type = other DNA
aacgaccacttccgaaggag

SEQ ID NO: 10408 - DNA, 20 bp, synthetic construct
  source 1..20: mol_type = other DNA
agacatgtccacacgcgact

SEQ ID NO: 10409 - DNA, 18 bp, synthetic construct
  source 1..18: mol_type = other DNA
aacccccgtgaacagctg

SEQ ID NO: 10410 - DNA, 18 bp, synthetic construct
  source 1..18: mol_type = other DNA
acacctggaccgctcgaa

SEQ ID NO: 10411 - DNA, 21 bp, synthetic construct
  source 1..21: mol_type = other DNA
aaggtcgtgacagaccacgac

SEQ ID NO: 10412 - DNA, 20 bp, synthetic construct
  source 1..20: mol_type = other DNA
aaccggtgccgatgtaaaac

SEQ ID NO: 10413 - DNA, 18 bp, synthetic construct
  source 1..18: mol_type = other DNA
acagcaaggagccctgga

SEQ ID NO: 10414 - DNA, 18 bp, synthetic construct
  source 1..18: mol_type = other DNA
agagcgccgtcggtaaga

SEQ ID NO: 10415 - DNA, 18 bp, synthetic construct
  source 1..18: mol_type = other DNA
acgcccgaaccggacctt

SEQ ID NO: 10416 - DNA, 19 bp, synthetic construct
  source 1..19: mol_type = other DNA
acaggtggtcggacacacg

SEQ ID NO: 10417 - DNA, 21 bp, synthetic construct
  source 1..21: mol_type = other DNA
aggaagagagttgtcggaaga

SEQ ID NO: 10418 - DNA, 20 bp, synthetic construct
  source 1..20: mol_type = other DNA
agacaggacgtccaccgaag

SEQ ID NO: 10419 - DNA, 18 bp, synthetic construct
  source 1..18: mol_type = other DNA
aagggcagccgtcgtgta

SEQ ID NO: 10420 - DNA, 21 bp, synthetic construct
  source 1..21: mol_type = other DNA
acggtagaagtgaccgagagt

SEQ ID NO: 10421 - DNA, 19 bp, synthetic construct
  source 1..19: mol_type = other DNA
acacgagggagctgagacg

SEQ ID NO: 10422 - DNA, 20 bp, synthetic construct
  source 1..20: mol_type = other DNA
aaccgtccacatctgcggtc

SEQ ID NO: 10423 - DNA, 18 bp, synthetic construct
  source 1..18: mol_type = other DNA
agaccgtcgacgtcctac

SEQ ID NO: 10424 - DNA, 18 bp, synthetic construct
  source 1..18: mol_type = other DNA
agggacttagggggaagg

SEQ ID NO: 10425 - DNA, 20 bp, synthetic construct
  source 1..20: mol_type = other DNA
accgacgacaaggggaggtc

SEQ ID NO: 10426 - DNA, 18 bp, synthetic construct
  source 1..18: mol_type = other DNA
aaccacgacaccaggacc

SEQ ID NO: 10427 - DNA, 21 bp, synthetic construct
  source 1..21: mol_type = other DNA
acccagtctcagtcagaccga

SEQ ID NO: 10428 - DNA, 19 bp, synthetic construct
  source 1..19: mol_type = other DNA
agggtggtccagggagggg

SEQ ID NO: 10429 - DNA, 20 bp, synthetic construct
  source 1..20: mol_type = other DNA
accctactcctacaacccgg

SEQ ID NO: 10430 - DNA, 18 bp, synthetic construct
  source 1..18: mol_type = other DNA
acgaggaagcccacccga

SEQ ID NO: 10431 - DNA, 20 bp, synthetic construct
  source 1..20: mol_type = other DNA
acggtgaggacactcagagg

SEQ ID NO: 10432 - DNA, 18 bp, synthetic construct
  source 1..18: mol_type = other DNA
accgacacgacgcctacg

SEQ ID NO: 10433 - DNA, 18 bp, synthetic construct
  source 1..18: mol_type = other DNA
acgtccagggcaagagga

SEQ ID NO: 10434 - DNA, 22 bp, synthetic construct
  source 1..22: mol_type = other DNA
acacaaagggttccggagggta

SEQ ID NO: 10435 - DNA, 19 bp, synthetic construct
  source 1..19: mol_type = other DNA
accctgagtaaccgacgaa

SEQ ID NO: 10436 - DNA, 18 bp, synthetic construct
  source 1..18: mol_type = other DNA
accaacagagggcagcgg

SEQ ID NO: 10437 - DNA, 21 bp, synthetic construct
  source 1..21: mol_type = other DNA
acacggagagacagagcgaga

SEQ ID NO: 10438 - DNA, 19 bp, synthetic construct
  source 1..19: mol_type = other DNA
accacagcgcctgccacag

SEQ ID NO: 10439 - DNA, 18 bp, synthetic construct
  source 1..18: mol_type = other DNA
acgccgacatgtcccagg

SEQ ID NO: 10440 - DNA, 22 bp, synthetic construct
  source 1..22: mol_type = other DNA
acgggggacaggtacctaatag

SEQ ID NO: 10441 - DNA, 22 bp, synthetic construct
  source 1..22: mol_type = other DNA
aaggcccagggtcaacttaaac

SEQ ID NO: 10442 - DNA, 20 bp, synthetic construct
  source 1..20: mol_type = other DNA
aggagggctcagaacacgaa

SEQ ID NO: 10443 - DNA, 18 bp, synthetic construct
  source 1..18: mol_type = other DNA
agaccactgcgcgaacag

SEQ ID NO: 10444 - DNA, 21 bp, synthetic construct
  source 1..21: mol_type = other DNA
agaggagggctggaacaggta

SEQ ID NO: 10445 - DNA, 18 bp, synthetic construct
  source 1..18: mol_type = other DNA
accagggttactcgaccg

SEQ ID NO: 10446 - DNA, 20 bp, synthetic construct
  source 1..20: mol_type = other DNA
acacagaagggtggccaagg

SEQ ID NO: 10447 - DNA, 18 bp, synthetic construct
  source 1..18: mol_type = other DNA
accgaggacgccagagac

SEQ ID NO: 10448 - DNA, 19 bp, synthetic construct
  source 1..19: mol_type = other DNA
aagggtcctgaccacctcg

SEQ ID NO: 10449 - DNA, 18 bp, synthetic construct
  source 1..18: mol_type = other DNA
acagccgggtctagtggg

SEQ ID NO: 10450 - DNA, 20 bp, synthetic construct
  source 1..20: mol_type = other DNA
agagcttctacgagcacctc

SEQ ID NO: 10451 - DNA, 18 bp, synthetic construct
  source 1..18: mol_type = other DNA
agcccggaccgggttaaa

SEQ ID NO: 10452 - DNA, 18 bp, synthetic construct
  source 1..18: mol_type = other DNA
accaactcgcaggggtcc

SEQ ID NO: 10453 - DNA, 18 bp, synthetic construct
  source 1..18: mol_type = other DNA
aacggtgagtggtggtgc

SEQ ID NO: 10454 - DNA, 18 bp, synthetic construct
  source 1..18: mol_type = other DNA
agcctgacgtgcaacagt

SEQ ID NO: 10455 - DNA, 18 bp, synthetic construct
  source 1..18: mol_type = other DNA
acgaacaccacggtgacc

SEQ ID NO: 10456 - DNA, 18 bp, synthetic construct
  source 1..18: mol_type = other DNA
aggggcaagacgtcgaag

SEQ ID NO: 10457 - DNA, 20 bp, synthetic construct
  source 1..20: mol_type = other DNA
aggagggctctcatcgcgac

SEQ ID NO: 10458 - DNA, 18 bp, synthetic construct
  source 1..18: mol_type = other DNA
accgacccacgactcgtc

SEQ ID NO: 10459 - DNA, 20 bp, synthetic construct
  source 1..20: mol_type = other DNA
aggaaaacggtggcatggat

SEQ ID NO: 10460 - DNA, 20 bp, synthetic construct
  source 1..20: mol_type = other DNA
aaccgtattgggacccgggc

SEQ ID NO: 10461 - DNA, 18 bp, synthetic construct
  source 1..18: mol_type = other DNA
acggcgactcgctgcact

SEQ ID NO: 10462 - DNA, 21 bp, synthetic construct
  source 1..21: mol_type = other DNA
aacgaccccaaacctccaagt

SEQ ID NO: 10463 - DNA, 18 bp, synthetic construct
  source 1..18: mol_type = other DNA
acccaccagctaaggtcc

SEQ ID NO: 10464 - DNA, 18 bp, synthetic construct
  source 1..18: mol_type = other DNA
acggctactaccggtccc

SEQ ID NO: 10465 - DNA, 18 bp, synthetic construct
  source 1..18: mol_type = other DNA
accgacgcaccatctacc

SEQ ID NO: 10466 - DNA, 21 bp, synthetic construct
  source 1..21: mol_type = other DNA
agacacaccgaagccctctag

SEQ ID NO: 10467 - DNA, 20 bp, synthetic construct
  source 1..20: mol_type = other DNA
agacggaggcctcgtcgtag

SEQ ID NO: 10468 - DNA, 19 bp, synthetic construct
  source 1..19: mol_type = other DNA
accaccatcgatacgcccc

SEQ ID NO: 10469 - DNA, 18 bp, synthetic construct
  source 1..18: mol_type = other DNA
acgaaccactggaagccc

SEQ ID NO: 10470 - DNA, 18 bp, synthetic construct
  source 1..18: mol_type = other DNA
acagctagtgggtcggct

SEQ ID NO: 10471 - DNA, 21 bp, synthetic construct
  source 1..21: mol_type = other DNA
actggcctcgaagagaagcct

SEQ ID NO: 10472 - DNA, 18 bp, synthetic construct
  source 1..18: mol_type = other DNA
aacgaggagtcgccaggt

SEQ ID NO: 10473 - DNA, 20 bp, synthetic construct
  source 1..20: mol_type = other DNA
aggaacagtcaccggtggac

SEQ ID NO: 10474 - DNA, 22 bp, synthetic construct
  source 1..22: mol_type = other DNA
accacaccggacgaaaagatcg

SEQ ID NO: 10475 - DNA, 22 bp, synthetic construct
  source 1..22: mol_type = other DNA
acaccgtaacgtaaacctacgg

SEQ ID NO: 10476 - DNA, 19 bp, synthetic construct
  source 1..19: mol_type = other DNA
atcgattcccacgaggcct

SEQ ID NO: 10477 - DNA, 18 bp, synthetic construct
  source 1..18: mol_type = other DNA
acagctctacgggccccc

SEQ ID NO: 10478 - DNA, 21 bp, synthetic construct
  source 1..21: mol_type = other DNA
agacggaagccataagacgag

SEQ ID NO: 10479 - DNA, 18 bp, synthetic construct
  source 1..18: mol_type = other DNA
acggcgaatctcttccgg

SEQ ID NO: 10480 - DNA, 18 bp, synthetic construct
  source 1..18: mol_type = other DNA
acacgtccgctacatggg

SEQ ID NO: 10481 - DNA, 20 bp, synthetic construct
  source 1..20: mol_type = other DNA
agccagtcgaccatgagctc

SEQ ID NO: 10482 - DNA, 19 bp, synthetic construct
  source 1..19: mol_type = other DNA
agaccgcagccaagactcc

SEQ ID NO: 10483 - DNA, 22 bp, synthetic construct
  source 1..22: mol_type = other DNA
acaacgaacccaccaagtccca

SEQ ID NO: 10484 - DNA, 21 bp, synthetic construct
  source 1..21: mol_type = other DNA
aggggccagtcacattccaag

SEQ ID NO: 10485 - DNA, 20 bp, synthetic construct
  source 1..20: mol_type = other DNA
agaggtagaccctgggtgac

SEQ ID NO: 10486 - DNA, 18 bp, synthetic construct
  source 1..18: mol_type = other DNA
acggatgccgtaagccga

SEQ ID NO: 10487 - DNA, 18 bp, synthetic construct
  source 1..18: mol_type = other DNA
aaggcacgccaggtggag

SEQ ID NO: 10488 - DNA, 18 bp, synthetic construct
  source 1..18: mol_type = other DNA
acccgctcggcaagtaca

SEQ ID NO: 10489 - DNA, 18 bp, synthetic construct
  source 1..18: mol_type = other DNA
acccaccggtcctcacaa

SEQ ID NO: 10490 - DNA, 21 bp, synthetic construct
  source 1..21: mol_type = other DNA
aggccgtagtagagcaaccgg

SEQ ID NO: 10491 - DNA, 20 bp, synthetic construct
  source 1..20: mol_type = other DNA
accacctccagcaacctctg

SEQ ID NO: 10492 - DNA, 21 bp, synthetic construct
  source 1..21: mol_type = other DNA
acgtcatcaggaaccaacacg

SEQ ID NO: 10493 - DNA, 21 bp, synthetic construct
  source 1..21: mol_type = other DNA
aaccagtccttcccgcactac

SEQ ID NO: 10494 - DNA, 18 bp, synthetic construct
  source 1..18: mol_type = other DNA
accacgccggtggtacga

SEQ ID NO: 10495 - DNA, 18 bp, synthetic construct
  source 1..18: mol_type = other DNA
accagcaggcgggtaccc

SEQ ID NO: 10496 - DNA, 19 bp, synthetic construct
  source 1..19: mol_type = other DNA
aaggagggacaggtccacg

SEQ ID NO: 10497 - DNA, 18 bp, synthetic construct
  source 1..18: mol_type = other DNA
actgcctcagaccccagg

SEQ ID NO: 10498 - DNA, 18 bp, synthetic construct
  source 1..18: mol_type = other DNA
acgggaacgtcggtcaac

SEQ ID NO: 10499 - DNA, 20 bp, synthetic construct
  source 1..20: mol_type = other DNA
aaccgtccgagtcgtcaaac

SEQ ID NO: 10500 - DNA, 18 bp, synthetic construct
  source 1..18: mol_type = other DNA
aacgcgaacctaccctcc

SEQ ID NO: 10501 - DNA, 18 bp, synthetic construct
  source 1..18: mol_type = other DNA
accagctacggtatccgg

SEQ ID NO: 10502 - DNA, 22 bp, synthetic construct
  source 1..22: mol_type = other DNA
agcaaccaactgtgcaacatgg

SEQ ID NO: 10503 - DNA, 18 bp, synthetic construct
  source 1..18: mol_type = other DNA
accagggaaaggtgccag

SEQ ID NO: 10504 - DNA, 20 bp, synthetic construct
  source 1..20: mol_type = other DNA
agctgccataaaacacggag

SEQ ID NO: 10505 - DNA, 21 bp, synthetic construct
  source 1..21: mol_type = other DNA
accccagatacaactcccgtc

SEQ ID NO: 10506 - DNA, 19 bp, synthetic construct
  source 1..19: mol_type = other DNA
aggacaggagtccgttccc

SEQ ID NO: 10507 - DNA, 20 bp, synthetic construct
  source 1..20: mol_type = other DNA
agtcgtacccctcccacgtg

SEQ ID NO: 10508 - DNA, 20 bp, synthetic construct
  source 1..20: mol_type = other DNA
aaggacaagtggcgacgggt

SEQ ID NO: 10509 - DNA, 19 bp, synthetic construct
  source 1..19: mol_type = other DNA
aggagtcagactccgcacc

SEQ ID NO: 10510 - DNA, 18 bp, synthetic construct
  source 1..18: mol_type = other DNA
acgagccacttcgagtcg

SEQ ID NO: 10511 - DNA, 18 bp, synthetic construct
  source 1..18: mol_type = other DNA
acccagtacgggagcgaa

SEQ ID NO: 10512 - DNA, 19 bp, synthetic construct
  source 1..19: mol_type = other DNA
aagcgggcagggacagtgc

SEQ ID NO: 10513 - DNA, 18 bp, synthetic construct
  source 1..18: mol_type = other DNA
aacgcaaactggggccag

SEQ ID NO: 10514 - DNA, 20 bp, synthetic construct
  source 1..20: mol_type = other DNA
aacccagaccctgctatggc

SEQ ID NO: 10515 - DNA, 19 bp, synthetic construct
  source 1..19: mol_type = other DNA
aaccagtgacggttcgacg

SEQ ID NO: 10516 - DNA, 20 bp, synthetic construct
  source 1..20: mol_type = other DNA
accggcctcaggtccctacc

SEQ ID NO: 10517 - DNA, 18 bp, synthetic construct
  source 1..18: mol_type = other DNA
acccccgttagagtcagg

SEQ ID NO: 10518 - DNA, 20 bp, synthetic construct
  source 1..20: mol_type = other DNA
aggggtcctcgactcggtag

SEQ ID NO: 10519 - DNA, 21 bp, synthetic construct
  source 1..21: mol_type = other DNA
acccggaacgacgaagtgtac

SEQ ID NO: 10520 - DNA, 20 bp, synthetic construct
  source 1..20: mol_type = other DNA
aacggagagtaacgttgcac

SEQ ID NO: 10521 - DNA, 22 bp, synthetic construct
  source 1..22: mol_type = other DNA
acaagacaggatccggcgaaga

SEQ ID NO: 10522 - DNA, 20 bp, synthetic construct
  source 1..20: mol_type = other DNA
acgacgggatccgacctgaa

SEQ ID NO: 10523 - DNA, 21 bp, synthetic construct
  source 1..21: mol_type = other DNA
acggatcacactggtccagcg

SEQ ID NO: 10524 - DNA, 18 bp, synthetic construct
  source 1..18: mol_type = other DNA
accgctacgtcagaagcc

SEQ ID NO: 10525 - DNA, 21 bp, synthetic construct
  source 1..21: mol_type = other DNA
aacgggtccgtaggtggtatg

SEQ ID NO: 10526 - DNA, 18 bp, synthetic construct
  source 1..18: mol_type = other DNA
aaggccactgtgggtggc

SEQ ID NO: 10527 - DNA, 19 bp, synthetic construct
  source 1..19: mol_type = other DNA
agaggcacctcgacttcgt

SEQ ID NO: 10528 - DNA, 18 bp, synthetic construct
  source 1..18: mol_type = other DNA
agacggtgtgtgacccga

SEQ ID NO: 10529 - DNA, 19 bp, synthetic construct
  source 1..19: mol_type = other DNA
acacccctcaactcgtcct

SEQ ID NO: 10530 - DNA, 20 bp, synthetic construct
  source 1..20: mol_type = other DNA
accagaaccatcccgacgtg

SEQ ID NO: 10531 - DNA, 19 bp, synthetic construct
  source 1..19: mol_type = other DNA
acacaactgtgtcgcgacg

SEQ ID NO: 10532 - DNA, 18 bp, synthetic construct
  source 1..18: mol_type = other DNA
agccctaacccgtgctca

SEQ ID NO: 10533 - DNA, 20 bp, synthetic construct
  source 1..20: mol_type = other DNA
acccgtggagctgagactcc

SEQ ID NO: 10534 - DNA, 19 bp, synthetic construct
  source 1..19: mol_type = other DNA
agacggccggccaacaagg

SEQ ID NO: 10535 - DNA, 20 bp, synthetic construct
  source 1..20: mol_type = other DNA
acgagacccgtgtctacgac

SEQ ID NO: 10536 - DNA, 21 bp, synthetic construct
  source 1..21: mol_type = other DNA
acgaagaaacagagtgcccag

SEQ ID NO: 10537 - DNA, 20 bp, synthetic construct
  source 1..20: mol_type = other DNA
agagcctcagactctcccgg

SEQ ID NO: 10538 - DNA, 18 bp, synthetic construct
  source 1..18: mol_type = other DNA
accccgaggtaaggagga

SEQ ID NO: 10539 - DNA, 21 bp, synthetic construct
  source 1..21: mol_type = other DNA
atccagaaccacttcggggcc

SEQ ID NO: 10540 - DNA, 22 bp, synthetic construct
  source 1..22: mol_type = other DNA
acgaaaagggtcacggagtacc

SEQ ID NO: 10541 - DNA, 19 bp, synthetic construct
  source 1..19: mol_type = other DNA
agacgtgactccgtaggct

SEQ ID NO: 10542 - DNA, 18 bp, synthetic construct
  source 1..18: mol_type = other DNA
acgccttacccaaggtcg

SEQ ID NO: 10543 - DNA, 18 bp, synthetic construct
  source 1..18: mol_type = other DNA
aaccggtcacgaacgacg

SEQ ID NO: 10544 - DNA, 19 bp, synthetic construct
  source 1..19: mol_type = other DNA
agaggtaaggaccggacac

SEQ ID NO: 10545 - DNA, 20 bp, synthetic construct
  source 1..20: mol_type = other DNA
acggagaccaggaactaggt

SEQ ID NO: 10546 - DNA, 20 bp, synthetic construct
  source 1..20: mol_type = other DNA
accaccgtggctaccactgc

SEQ ID NO: 10547 - DNA, 22 bp, synthetic construct
  source 1..22: mol_type = other DNA
agcaacatgtgggtcagacggt

SEQ ID NO: 10548 - DNA, 21 bp, synthetic construct
  source 1..21: mol_type = other DNA
acagggtgaaactccaggagc

SEQ ID NO: 10549 - DNA, 18 bp, synthetic construct
  source 1..18: mol_type = other DNA
accagggcgtggcacgtc

SEQ ID NO: 10550 - DNA, 18 bp, synthetic construct
  source 1..18: mol_type = other DNA
agcggaggttagacggcc

SEQ ID NO: 10551 - DNA, 22 bp, synthetic construct
  source 1..22: mol_type = other DNA
aacccgactggactgtctaaag

SEQ ID NO: 10552 - DNA, 20 bp, synthetic construct
  source 1..20: mol_type = other DNA
agcgcctacccaagctacct

SEQ ID NO: 10553 - DNA, 18 bp, synthetic construct
  source 1..18: mol_type = other DNA
aacggcagccccaggaag

SEQ ID NO: 10554 - DNA, 18 bp, synthetic construct
  source 1..18: mol_type = other DNA
acgctcgtcggacgtggg

SEQ ID NO: 10555 - DNA, 20 bp, synthetic construct
  source 1..20: mol_type = other DNA
accatgaggagggcgacgaa

SEQ ID NO: 10556 - DNA, 20 bp, synthetic construct
  source 1..20: mol_type = other DNA
acgagaacggaaacggcggc

SEQ ID NO: 10557 - DNA, 19 bp, synthetic construct
  source 1..19: mol_type = other DNA
acgaacactccatcccgcc

SEQ ID NO: 10558 - DNA, 20 bp, synthetic construct
  source 1..20: mol_type = other DNA
aggagggggtgagagtgtcc

SEQ ID NO: 10559 - DNA, 20 bp, synthetic construct
  source 1..20: mol_type = other DNA
accgacaccctaccccatcc

SEQ ID NO: 10560 - DNA, 21 bp, synthetic construct
  source 1..21: mol_type = other DNA
acgaagacgacgtcggagtcc

SEQ ID NO: 10561 - DNA, 18 bp, synthetic construct
  source 1..18: mol_type = other DNA
accgggtaggaccagcta

SEQ ID NO: 10562 - DNA, 20 bp, synthetic construct
  source 1..20: mol_type = other DNA
accacgtagaacggttcaaa

SEQ ID NO: 10563 - DNA, 22 bp, synthetic construct
  source 1..22: mol_type = other DNA
acccaactgtcaggtcacaacg

SEQ ID NO: 10564 - DNA, 21 bp, synthetic construct
  source 1..21: mol_type = other DNA
accacatccgcatctgcctcc

SEQ ID NO: 10565 - DNA, 19 bp, synthetic construct
  source 1..19: mol_type = other DNA
aggagcatggacgtgagcg

SEQ ID NO: 10566 - DNA, 20 bp, synthetic construct
  source 1..20: mol_type = other DNA
acggtcctctcggcagggac

SEQ ID NO: 10567 - DNA, 20 bp, synthetic construct
  source 1..20: mol_type = other DNA
acctctcccaggactgaggg

SEQ ID NO: 10568 - DNA, 18 bp, synthetic construct
  source 1..18: mol_type = other DNA
acaccgcgtctcggcgtc

SEQ ID NO: 10569 - DNA, 21 bp, synthetic construct
  source 1..21: mol_type = other DNA
aaggaggaggcgtaggacgtt

SEQ ID NO: 10570 - DNA, 20 bp, synthetic construct
  source 1..20: mol_type = other DNA
acgacagggtgacatgggga

SEQ ID NO: 10571 - DNA, 25 bp, synthetic construct
  source 1..25: mol_type = other DNA
accgacaggacacagtgtacgataa

SEQ ID NO: 10572 - DNA, 20 bp, synthetic construct
  source 1..20: mol_type = other DNA
aggagggggaacttcgacac

SEQ ID NO: 10573 - DNA, 18 bp, synthetic construct
  source 1..18: mol_type = other DNA
aaggccgtcggacacgtc

SEQ ID NO: 10574 - DNA, 21 bp, synthetic construct
  source 1..21: mol_type = other DNA
acagaagacgagggtgaaaga

SEQ ID NO: 10575 - DNA, 20 bp, synthetic construct
  source 1..20: mol_type = other DNA
agagagaggacgccgtagca

SEQ ID NO: 10576 - DNA, 18 bp, synthetic construct
  source 1..18: mol_type = other DNA
actggaacaggtccccga

SEQ ID NO: 10577 - DNA, 21 bp, synthetic construct
  source 1..21: mol_type = other DNA
acccatgagcaggaggaacgt

SEQ ID NO: 10578 - DNA, 20 bp, synthetic construct
  source 1..20: mol_type = other DNA
agccaaacgagaactacgtc

SEQ ID NO: 10579 - DNA, 21 bp, synthetic construct
  source 1..21: mol_type = other DNA
acacagagagagagggaggac

SEQ ID NO: 10580 - DNA, 20 bp, synthetic construct
  source 1..20: mol_type = other DNA
aggaagttcgagggggagaa

SEQ ID NO: 10581 - DNA, 18 bp, synthetic construct
  source 1..18: mol_type = other DNA
acccgcacgacctgaaga

SEQ ID NO: 10582 - DNA, 18 bp, synthetic construct
  source 1..18: mol_type = other DNA
acacccgcgacaggttcc

SEQ ID NO: 10583 - DNA, 19 bp, synthetic construct
  source 1..19: mol_type = other DNA
agggacactccaagacccg

SEQ ID NO: 10584 - DNA, 20 bp, synthetic construct
  source 1..20: mol_type = other DNA
acgccgacacccactacgtc

SEQ ID NO: 10585 - DNA, 18 bp, synthetic construct
  source 1..18: mol_type = other DNA
agggagaggaagcagggt

SEQ ID NO: 10586 - DNA, 18 bp, synthetic construct
  source 1..18: mol_type = other DNA
agacagggtccgacccag

SEQ ID NO: 10587 - DNA, 20 bp, synthetic construct
  source 1..20: mol_type = other DNA
accaacggtgtagtggagac

SEQ ID NO: 10588 - DNA, 18 bp, synthetic construct
  source 1..18: mol_type = other DNA
aggagccccatcgcccca

SEQ ID NO: 10589 - DNA, 21 bp, synthetic construct
  source 1..21: mol_type = other DNA
acgtaaccctcggtgaaccgg

SEQ ID NO: 10590 - DNA, 18 bp, synthetic construct
  source 1..18: mol_type = other DNA
agacaggtccacccgacg

SEQ ID NO: 10591 - DNA, 18 bp, synthetic construct
  source 1..18: mol_type = other DNA
acacgtcccggagtaacg

SEQ ID NO: 10592 - DNA, 20 bp, synthetic construct
  source 1..20: mol_type = other DNA
aacgggacgtgatggagaca

SEQ ID NO: 10593 - DNA, 18 bp, synthetic construct
  source 1..18: mol_type = other DNA
agagggcacatccgcggt

SEQ ID NO: 10594 - DNA, 20 bp, synthetic construct
  source 1..20: mol_type = other DNA
aactgaacccacctcgaacc

SEQ ID NO: 10595 - DNA, 18 bp, synthetic construct
  source 1..18: mol_type = other DNA
aggaggacccagggaccg

SEQ ID NO: 10596 - DNA, 21 bp, synthetic construct
  source 1..21: mol_type = other DNA
acggtcgtagaaccactggac

SEQ ID NO: 10597 - DNA, 20 bp, synthetic construct
  source 1..20: mol_type = other DNA
aagaccggtacaacccccgt

SEQ ID NO: 10598 - DNA, 21 bp, synthetic construct
  source 1..21: mol_type = other DNA
agacgagggtacttcgggtca

SEQ ID NO: 10599 - DNA, 21 bp, synthetic construct
  source 1..21: mol_type = other DNA
aagtctcagacgcatgacccg

SEQ ID NO: 10600 - DNA, 21 bp, synthetic construct
  source 1..21: mol_type = other DNA
atcgcaggcacattcaggagt

SEQ ID NO: 10601 - DNA, 21 bp, synthetic construct
  source 1..21: mol_type = other DNA
aggatcctatggacagcggtg

SEQ ID NO: 10602 - DNA, 18 bp, synthetic construct
  source 1..18: mol_type = other DNA
agccccctgacactcggc

SEQ ID NO: 10603 - DNA, 19 bp, synthetic construct
  source 1..19: mol_type = other DNA
aacgacggtccacacgccc

SEQ ID NO: 10604 - DNA, 20 bp, synthetic construct
  source 1..20: mol_type = other DNA
acgccagccctatgaggagt

SEQ ID NO: 10605 - DNA, 18 bp, synthetic construct
  source 1..18: mol_type = other DNA
aaccggagaagacgacgg

SEQ ID NO: 10606 - DNA, 18 bp, synthetic construct
  source 1..18: mol_type = other DNA
agggagcccgcaaggtaa

SEQ ID NO: 10607 - DNA, 18 bp, synthetic construct
  source 1..18: mol_type = other DNA
acaggagacggtcgtacg

SEQ ID NO: 10608 - DNA, 18 bp, synthetic construct
  source 1..18: mol_type = other DNA
aaccgggtaggagccacg

SEQ ID NO: 10609 - DNA, 22 bp, synthetic construct
  source 1..22: mol_type = other DNA
acggaaaacggacatgagacca

SEQ ID NO: 10610 - DNA, 22 bp, synthetic construct
  source 1..22: mol_type = other DNA
acccacacattaagaggtcgac

SEQ ID NO: 10611 - DNA, 19 bp, synthetic construct
  source 1..19: mol_type = other DNA
agacggggtggagagagtc

SEQ ID NO: 10612 - DNA, 18 bp, synthetic construct
  source 1..18: mol_type = other DNA
acacccgtagacaggacc

SEQ ID NO: 10613 - DNA, 20 bp, synthetic construct
  source 1..20: mol_type = other DNA
acctatccgcgtccaacacc

SEQ ID NO: 10614 - DNA, 21 bp, synthetic construct
  source 1..21: mol_type = other DNA
agaccgcctacctgtcaccct

SEQ ID NO: 10615 - DNA, 21 bp, synthetic construct
  source 1..21: mol_type = other DNA
acggaactacaagtgtccgac

SEQ ID NO: 10616 - DNA, 20 bp, synthetic construct
  source 1..20: mol_type = other DNA
aacgggaacaaggagacctc

SEQ ID NO: 10617 - DNA, 19 bp, synthetic construct
  source 1..19: mol_type = other DNA
aaccagacttgcgacgacg

SEQ ID NO: 10618 - DNA, 20 bp, synthetic construct
  source 1..20: mol_type = other DNA
aggccctcgaaggaagtgac

SEQ ID NO: 10619 - DNA, 19 bp, synthetic construct
  source 1..19: mol_type = other DNA
agggcgtaggaagttgacc

SEQ ID NO: 10620 - DNA, 19 bp, synthetic construct
  source 1..19: mol_type = other DNA
acgagtcaccagacacggg

SEQ ID NO: 10621 - DNA, 19 bp, synthetic construct
  source 1..19: mol_type = other DNA
acacgagggcgaacatggg

SEQ ID NO: 10622 - DNA, 18 bp, synthetic construct
  source 1..18: mol_type = other DNA
accaccccgtccagaaca

SEQ ID NO: 10623 - DNA, 18 bp, synthetic construct
  source 1..18: mol_type = other DNA
acggccataaaccccaag

SEQ ID NO: 10624 - DNA, 22 bp, synthetic construct
  source 1..22: mol_type = other DNA
agagtccgaggaacccatgtaa

SEQ ID NO: 10625 - DNA, 21 bp, synthetic construct
  source 1..21: mol_type = other DNA
agacacccccagaactgtgcc

SEQ ID NO: 10626 - DNA, 18 bp, synthetic construct
  source 1..18: mol_type = other DNA
aacggtaggctgtcgacc

SEQ ID NO: 10627 - DNA, 18 bp, synthetic construct
  source 1..18: mol_type = other DNA
acggactgaaaccggagc

SEQ ID NO: 10628 - DNA, 20 bp, synthetic construct
  source 1..20: mol_type = other DNA
agcaaaagacggctcgagac

SEQ ID NO: 10629 - DNA, 21 bp, synthetic construct
  source 1..21: mol_type = other DNA
aggaaggcggaaaagaccctc

SEQ ID NO: 10630 - DNA, 18 bp, synthetic construct
  source 1..18: mol_type = other DNA
acccaagtgtccaccgtc

SEQ ID NO: 10631 - DNA, 18 bp, synthetic construct
  source 1..18: mol_type = other DNA
aaccccgactcgacgtca

SEQ ID NO: 10632 - DNA, 18 bp, synthetic construct
  source 1..18: mol_type = other DNA
acggacagaacacagggc

SEQ ID NO: 10633 - DNA, 18 bp, synthetic construct
  source 1..18: mol_type = other DNA
acgggaggctgcagaaca

SEQ ID NO: 10634 - DNA, 18 bp, synthetic construct
  source 1..18: mol_type = other DNA
acgggaggctccagaaca

SEQ ID NO: 10635 - DNA, 18 bp, synthetic construct
  source 1..18: mol_type = other DNA
aaccgctcctcccgggga

SEQ ID NO: 10636 - DNA, 21 bp, synthetic construct
  source 1..21: mol_type = other DNA
acggagagtcgaagggcaacg

SEQ ID NO: 10637 - DNA, 18 bp, synthetic construct
  source 1..18: mol_type = other DNA
aggcgtgtctgcaccaga

SEQ ID NO: 10638 - DNA, 19 bp, synthetic construct
  source 1..19: mol_type = other DNA
aagcatcggtctcgaccgc

SEQ ID NO: 10639 - DNA, 20 bp, synthetic construct
  source 1..20: mol_type = other DNA
accaccgacttcgagaaggc

SEQ ID NO: 10640 - DNA, 25 bp, synthetic construct
  source 1..25: mol_type = other DNA
aggtacaacaaccaacaacctggtc

What is claimed is:

1. A method of preparing a plurality of sample-barcoded anchor-domain-flanked gene specific DNA fragments from a template RNA sample, the method comprising:

contacting the template RNA sample with reverse primers of a set of GSPs (Gene Specific Primers), wherein the reverse primers comprise an anchor domain and a sample barcode domain common to the reverse primers of the set of GSPs, to produce a hybrid composition comprising RNA/anchored sample barcoded reverse primer hybrids;

removing unbound reverse primers from the hybrid composition to produce a hybrid enriched composition;

reverse transcribing the hybrid enriched composition to produce a cDNA composition; and contacting the cDNA composition with forward primers of the set, wherein the forward primers comprise an anchor domain, under primer extension reaction conditions to produce the plurality of sample-barcoded anchor-domain-flanked gene specific DNA fragments from the template RNA sample.

2. The method according to claim 1, wherein the reverse primers further comprise a unique molecular identifier (UMI) domain.

3. The method according to claim 1, wherein the template RNA sample is obtained from a single cell.

4. The method according to claim 3, wherein the method comprises obtaining the template RNA sample by isolating the single cell and then lysing the isolated single cell to produce the template RNA sample.

5. The method according to claim 4, wherein the cell is isolated and lysed in a well.

6. The method according to claim 4, wherein the cell is isolated and lysed in a droplet.

7. The method according to claim 6, wherein the droplet is produced using microfluidics.

8. The method according to claim 6, wherein the droplet is produced using a fluorescence activated cell sorter (FACS).

9. The method according to claim 1, wherein the method comprises a pooling step.

10. The method according to claim 9, wherein the pooling step comprises pooling the enriched hybrid composition with at least one additional enriched hybrid composition produced form at least one additional template RNA sample.

11. The method according to claim 1, wherein the method further comprises removing non-extended forward primers from the plurality of sample-barcoded anchor-domain-flanked gene specific DNA fragments.

12. The method according to claim 1, wherein the GSP domain of each forward primer ranges in length from 18 to 25 nucleotides (nt).

13. The method according to claim 1, wherein the GSP domain of each reverse primer ranges in length from 30 to 70 nt.

14. The method according to claim 1, wherein the flanking anchor domains comprise a universal priming site and the method further comprises amplifying the sample-barcoded anchor-domain-flanked gene specific DNA fragments comprising the anchor domains with universal forward and reverse primers having sequences complementary to the universal priming sites under amplification conditions sufficient to produce a barcoded amplicon composition comprising multiple product amplicons.

15. The method according to claim 14, wherein the universal forward and reverse primers further comprise Next-Generation Sequencing (NGS) adaptor domains.

16. The method according to claim 15, wherein the method further comprises adding NGS adaptor domains to the multiple product amplicons of the barcoded amplicon composition.

17. The method according claim 16, wherein the NGS adaptor domains are added to the multiple product amplicons of the barcoded amplicon composition by amplification.

18. The method according to claim 14, wherein the method further comprises sequencing the multiple product amplicons.

19. The method according to claim 18, wherein the multiple product amplicons are sequenced using an NGS protocol.

20. The method of claim 5, wherein the cell is deposited into the well using a cell sorter.

21. The method of claim 20, wherein the cell sorter is a fluorescence activated cell sorter (FACS).

22. The method according to claim 5, wherein the well is an individual well of a device comprising a plurality of wells.

23. The method according to claim 22, wherein the individual well contains the reverse primers of a set of GSPs.

24. The method according to claim 23, wherein the sample barcode domain common to the reverse primers of the set of GSPs is specific to the well.

* * * * *